United States Patent
Dimarchi et al.

(10) Patent No.: US 10,232,020 B2
(45) Date of Patent: Mar. 19, 2019

(54) INCRETIN-INSULIN CONJUGATES

(71) Applicant: INDIANA UNIVERSITY RESEARCH AND TECHNOLOGY CORPORATION, Indianapolis, IN (US)

(72) Inventors: Richard D. Dimarchi, Carmel, IN (US); John P. Mayer, Indianapolis, IN (US); David L. Smiley, Bloomington, IN (US); Fa Liu, Zionsville, IN (US)

(73) Assignee: Indiana University Research and Technology Corporation, Indianapolis, IN (US)

( * ) Notice: Subject to any disclaimer, the term of this patent is extended or adjusted under 35 U.S.C. 154(b) by 0 days.

(21) Appl. No.: 15/513,748

(22) PCT Filed: Sep. 23, 2015

(86) PCT No.: PCT/US2015/051728
§ 371 (c)(1),
(2) Date: Mar. 23, 2017

(87) PCT Pub. No.: WO2016/049190
PCT Pub. Date: Mar. 31, 2016

(65) Prior Publication Data
US 2017/0281788 A1    Oct. 5, 2017

Related U.S. Application Data

(60) Provisional application No. 62/054,666, filed on Sep. 24, 2014.

(51) Int. Cl.
| | |
|---|---|
| *A61K 38/28* | (2006.01) |
| *A61K 38/22* | (2006.01) |
| *A61K 47/48* | (2006.01) |
| *C07K 14/575* | (2006.01) |
| *C07K 14/605* | (2006.01) |
| *C07K 14/62* | (2006.01) |
| *A61K 47/64* | (2017.01) |
| *A61K 38/00* | (2006.01) |
| *A61K 9/00* | (2006.01) |
| *A61K 47/02* | (2006.01) |
| *C07K 2/00* | (2006.01) |

(52) U.S. Cl.
CPC ........... *A61K 38/22* (2013.01); *A61K 38/28* (2013.01); *A61K 47/48061* (2013.01); *A61K 47/48246* (2013.01); *A61K 47/64* (2017.08); *C07K 14/575* (2013.01); *C07K 14/605* (2013.01); *C07K 14/62* (2013.01); *A61K 9/0019* (2013.01); *A61K 9/0024* (2013.01); *A61K 38/00* (2013.01); *A61K 47/02* (2013.01); *C07K 2/00* (2013.01)

(58) Field of Classification Search
CPC ........... A61K 47/48246; A61K 38/22; A61K 47/48061; A61K 38/28; A61K 47/64; A61K 38/00; A61K 9/0019; A61K 9/0024; A61K 47/02; C07K 2/00; C07K 14/575; C07K 14/605; C07K 14/62
See application file for complete search history.

(56) References Cited

U.S. PATENT DOCUMENTS

| | | |
|---|---|---|
| 3,740,385 A | 6/1973 | Ondetti |
| 4,275,152 A | 6/1981 | Esders et al. |
| 4,741,897 A | 5/1988 | Andrews et al. |
| 4,876,242 A | 10/1989 | Applebaum et al. |
| 4,985,407 A | 1/1991 | Foxton et al. |
| 5,028,586 A | 7/1991 | Balschmidt et al. |
| 5,359,030 A | 10/1994 | Ekwuribe |
| 5,510,459 A | 4/1996 | Smith et al. |
| 5,512,549 A | 4/1996 | Chen et al. |
| 5,514,646 A | 5/1996 | Chance et al. |
| 5,545,618 A | 8/1996 | Buckley et al. |
| 5,665,705 A | 9/1997 | Merrifield et al. |
| 5,759,818 A | 6/1998 | Boime |
| 5,783,674 A | 7/1998 | Geysin et al. |
| 5,843,634 A | 12/1998 | Brate et al. |
| 6,180,767 B1 | 1/2001 | Wickstrom et al. |
| 6,191,102 B1 | 2/2001 | DiMarchi et al. |
| 6,197,926 B1 | 3/2001 | Gaur et al. |
| 6,329,336 B1 | 12/2001 | Bridon et al. |
| 6,476,290 B1 | 11/2002 | Wright et al. |
| 6,583,111 B1 | 6/2003 | DiMarchi et al. |
| 6,630,348 B1 | 10/2003 | Lee et al. |
| 6,677,136 B2 | 1/2004 | Marshall et al. |

(Continued)

FOREIGN PATENT DOCUMENTS

| | | |
|---|---|---|
| EP | 0220958 | 5/1987 |
| EP | 741188 | 11/1996 |

(Continued)

OTHER PUBLICATIONS

PCT International Search Report and Written Opinion completed by the ISA/US on Nov. 5, 2011 and issued in connection with PCT/US2015/051728 8 pages.
"Application of Chemical Biotechnology to Optimization of Endocrine Hormones," Carothers Lecture, Mar. 22, 2007.
"Biotechnology—A Basis for Better Health & Economic Prosperity," Ohio State University presentation, Aug. 28, 2010.
"Biotechnology—A Basis for Better Health & Economic Prosperity," Indiana University television presentation, Nov. 2010.
"Emergence of Chemical Biotechnology," Eli Lilly and Co. presentation, Jun. 22, 2009.

(Continued)

*Primary Examiner* — Julie Ha
*Assistant Examiner* — Li N Komatsu
(74) *Attorney, Agent, or Firm* — Barnes & Thornburg LLP

(57) ABSTRACT

Disclosed herein are insulin agonist peptides conjugated to incretins wherein the incretin-insulin conjugate has agonist activity at the insulin receptor and the corresponding incretin receptor, and stimulates weight loss in an individual administered the compound.

19 Claims, 62 Drawing Sheets

Specification includes a Sequence Listing.

(56) References Cited

U.S. PATENT DOCUMENTS

| | | |
|---|---|---|
| 6,746,853 B1 | 6/2004 | Dahiyat et al. |
| 7,045,337 B2 | 5/2006 | Schultz et al. |
| 7,192,922 B2 | 3/2007 | Shannon et al. |
| 7,211,557 B2 | 5/2007 | DiMarchi et al. |
| 7,326,688 B2 | 2/2008 | O'Harte et al. |
| 7,521,422 B2 | 4/2009 | Bernard |
| 7,557,183 B2 | 7/2009 | DiMarchi et al. |
| 7,576,059 B2 | 8/2009 | Jonassen et al. |
| 8,053,560 B2 | 11/2011 | Sheffer et al. |
| 9,573,987 B2 | 2/2017 | DiMarchi et al. |
| 2002/0038026 A1 | 3/2002 | Rao et al. |
| 2002/0049164 A1 | 4/2002 | Demuth et al. |
| 2002/0160938 A1 | 10/2002 | Brandenburg et al. |
| 2003/0021795 A1 | 1/2003 | Houston et al. |
| 2003/0143183 A1 | 7/2003 | Knudsen et al. |
| 2003/0195147 A1 | 10/2003 | Pillutla et al. |
| 2003/0195157 A1 | 10/2003 | Natarajan et al. |
| 2003/0204063 A1 | 10/2003 | Gravel et al. |
| 2004/0002468 A1 | 1/2004 | Wadsworth et al. |
| 2004/0054130 A1 | 3/2004 | Ng et al. |
| 2004/0121940 A1 | 6/2004 | DeGroot et al. |
| 2004/0235710 A1 | 11/2004 | DeFilippis et al. |
| 2005/0014679 A1 | 1/2005 | Beals et al. |
| 2005/0070469 A1 | 3/2005 | Bloom et al. |
| 2005/0095679 A1 | 5/2005 | Prescott et al. |
| 2005/0124550 A1 | 6/2005 | Peri |
| 2005/0153890 A1 | 7/2005 | Pan et al. |
| 2005/0187147 A1 | 8/2005 | Newman et al. |
| 2005/0288248 A1 | 12/2005 | Pan et al. |
| 2006/0003417 A1 | 1/2006 | Pan et al. |
| 2006/0003935 A1 | 1/2006 | Pan et al. |
| 2006/0084604 A1 | 4/2006 | Kitaura et al. |
| 2006/0171920 A1 | 8/2006 | Shechter et al. |
| 2006/0210534 A1 | 9/2006 | Lee et al. |
| 2006/0223753 A1 | 10/2006 | Glass |
| 2006/0252916 A1 | 11/2006 | DiMarchi et al. |
| 2006/0286129 A1 | 12/2006 | Sarubbi |
| 2007/0004623 A1 | 1/2007 | Bellini et al. |
| 2007/0042956 A1 | 2/2007 | Johansen et al. |
| 2007/0129284 A1 | 6/2007 | Kjeldsen et al. |
| 2007/0173452 A1 | 7/2007 | DiMarchi et al. |
| 2007/0203058 A1 | 8/2007 | Lau et al. |
| 2007/0224119 A1 | 9/2007 | McTavish |
| 2007/0287670 A1 | 12/2007 | Natarajan et al. |
| 2008/0113411 A1 | 5/2008 | Sheffer |
| 2008/0113905 A1 | 5/2008 | DiMarchi et al. |
| 2008/0125574 A1 | 5/2008 | Sheffer et al. |
| 2008/0242595 A1 | 10/2008 | Doyle |
| 2008/0299096 A1 | 12/2008 | Tatake et al. |
| 2008/0312157 A1 | 12/2008 | Levy et al. |
| 2008/0318837 A1 | 12/2008 | Quay et al. |
| 2009/0036364 A1 | 2/2009 | Levy et al. |
| 2009/0054305 A1 | 2/2009 | Schlein et al. |
| 2009/0062192 A1 | 3/2009 | Christensen et al. |
| 2009/0074769 A1 | 3/2009 | Glaesner et al. |
| 2009/0137456 A1 | 5/2009 | DiMarchi et al. |
| 2009/0176964 A1 | 7/2009 | Walensky et al. |
| 2009/0186817 A1 | 7/2009 | Ghosh et al. |
| 2009/0192072 A1 | 7/2009 | Pillutla et al. |
| 2009/0209453 A1 | 8/2009 | Moyle |
| 2009/0221037 A1 | 9/2009 | Lee et al. |
| 2010/0022455 A1 | 1/2010 | Chilkoti |
| 2010/0081614 A1 | 4/2010 | Fares et al. |
| 2010/0190699 A1 | 7/2010 | DiMarchi et al. |
| 2010/0190701 A1 | 7/2010 | Day et al. |
| 2010/0204105 A1 | 8/2010 | Riber et al. |
| 2011/0065633 A1 | 3/2011 | DiMarchi et al. |
| 2011/0098217 A1 | 4/2011 | DiMarchi et al. |
| 2011/0166062 A1 | 7/2011 | DiMarchi et al. |
| 2011/0190200 A1 | 8/2011 | DiMarchi et al. |
| 2011/0257076 A1* | 10/2011 | DiMarchi ............ A61K 38/28 514/1.3 |
| 2011/0257091 A1 | 10/2011 | DiMarchi |
| 2011/0257092 A1 | 10/2011 | DiMarchi et al. |
| 2011/0288003 A1 | 11/2011 | DiMarchi et al. |
| 2012/0010134 A1 | 1/2012 | Zion et al. |
| 2012/0021978 A1 | 1/2012 | Werner et al. |
| 2012/0184489 A1 | 7/2012 | Rau et al. |
| 2014/0120120 A1 | 5/2014 | Woo et al. |

FOREIGN PATENT DOCUMENTS

| | | |
|---|---|---|
| EP | 1161452 | 2/2000 |
| EP | 2036539 A1 | 3/2009 |
| EP | 2036923 A1 | 3/2009 |
| WO | 1990/12814 | 11/1990 |
| WO | 1993/03174 | 2/1993 |
| WO | 1996/34882 | 11/1996 |
| WO | 1998/11126 | 3/1998 |
| WO | 1999/46283 | 9/1999 |
| WO | 2000/50456 | 8/2000 |
| WO | 2002/010195 | 2/2002 |
| WO | 2004/067548 | 8/2004 |
| WO | 2004/078777 | 9/2004 |
| WO | 2005/054291 | 6/2005 |
| WO | 2006/047214 | 5/2006 |
| WO | 2006/097521 | 9/2006 |
| WO | 2007/096332 | 8/2007 |
| WO | 2008/019368 | 2/2008 |
| WO | 2008/021560 | 2/2008 |
| WO | 2008/025528 | 3/2008 |
| WO | 2008/081418 | 7/2008 |
| WO | WO09034118 A1 | 3/2009 |
| WO | WO09034119 A1 | 3/2009 |
| WO | 2009/067636 | 5/2009 |
| WO | 2009/095479 | 8/2009 |
| WO | 2009/099763 | 8/2009 |
| WO | 2010/011313 | 1/2010 |
| WO | 2010/071807 | 6/2010 |
| WO | 2010/080605 | 7/2010 |
| WO | 2010/080607 | 7/2010 |
| WO | 2010/080609 | 7/2010 |
| WO | 2011/012718 | 2/2011 |
| WO | 2011/159895 | 12/2011 |
| WO | 2011/163012 | 12/2011 |
| WO | 2011/163460 | 12/2011 |
| WO | 2011/163462 | 12/2011 |
| WO | 2012/098462 | 7/2012 |
| WO | WO-2012138941 A1 * | 10/2012 ............ A61K 38/26 |
| WO | 2012/165915 | 12/2012 |
| WO | 2013/096386 | 6/2013 |
| WO | 2014/158900 | 10/2014 |

OTHER PUBLICATIONS

"Legacy Products—'Back to the Future'," presentation to Eli Lilly and Co., Sep. 22, 2005.

"Molecular Miracles," Indiana University, Apr. 13, 2011.

"Novel Glucagon Peptides That Demonstrate the Virtues of Combinatorial Pharmacology," University of Toledo, Mar. 22, 2012.

"Novel Glucagon-Based Peptides—Virtues of Combinatorial Pharmacology," European Peptide Symposium, Sep. 5-9, 2010, Copenhagen, Denmark.

"Novel Glucagon-Based Peptides—Virtues of Combinatorial Pharmacology," University of Michigan, Oct. 13, 2010.

"Novel Glucagon-Based Peptides—Virtues of Combinatorial Pharmacology," Yale University, May 13, 2011.

"Novel Glucagon-Based Peptides—Virtues of Combinatorial Pharmacology," Aug. 31, 2011, Berlin.

"Novel Glucagon-Like Chimera Peptides—Virtues of Combinatorial Pharmacology," Keystone Conference, Apr. 12-17, 2010, Whistler, B.C.

"Novel Glucagon-Like Chimera Peptides—Virtues of Combinatorial Pharmacology," AAPS May 2010.

"Novel Glucagon-Like Chimera Peptides—Virtues of Combinatorial Pharmacology," University of Cincinnati, Jun. 2010.

"Novel Glucagon-Like Chimera Peptides—Virtues of Combinatorial Pharmacology," AAPS 2005 San Francisco.

"Peptides: Frontiers of Peptide Science," Proceedings of the Fifteenth American Peptide Symposium, Jun. 14-19, 1997, Nashville, Tennessee, USA; ed. James P. Tam and Praven T.P. Kaumaya.

(56) References Cited

OTHER PUBLICATIONS

"Speaking From the Gut: From Gastrointestinal Hormones to Combinatorial Therapies," Presentation to American Diabetes Association, Jun. 25, 2011.
"The Emergence of Chemical Biotechnology & Its Application to Optimization of Endocrine Hormones," UMBC presentation, Mar. 26, 2008.
"The Pursuit of Transformational Medicines," Keystone presentation, Jan. 29-Feb. 3, 2012, Santa Fe, NM.
"The Pursuit of Transformational Medicines," NP2D presentation, Dec. 4, 2011.
"The Pursuit of Transformational Medicines," presentation to American Peptide Symposium, Jun. 25-30, 2011, San Diego, CA.
"Two for the Money" Gut Hormone Hybrids, Tschoep, ADA meeting, Jun. 25-29, 2010, Orlando, FL.
Althage et al.,JBC "Targeted Ablation of GIP-Producing Cells in Transgenic mice reduces obesity and insulin resistance induced by a high fat diet" 2008).
Andrews et al., "Forming Stable Helical Peptides Using Natural and Artificial Amino Acids", Tetrahedron 55: 11711-11743, (1999).
Azizeh et al., "Pure glucagon antagonists: biological activities and cAMP accumulation using phosphodiesterase inhibitors," Peptides 1997, vol. 18, No. 5, pp. 633-641.
Azizeh et al., "Topographical amino acid substitution in position 10 of glucagon leads to antagonists/partial agonists with greater binding differences," J. Med. Chem., vol. 39, No. 13, Jun. 21, 1996, pp. 2449-2455.
Azizeh et al., "The role of phenylalanine at position 6 in glucagon's mechanism of biological action: multiple replacement analogues of glucagon" J Med Chem 1997, 40, 2555-2562.
Blache et al., "Development of an oxyntomodulin/glicentin C-terminal radioimmunoassay using a "thiol-maleoyl" coupling method for preparing the immunogen," Anal Biochem 1988 173(1):151-159 (1988), abstract only.
Breiner, M., et al., Heterogeneity of Insulin-Receptors in Rat-Tissues as Detected with the Partial Agonist B29,B29'-Suberoyl-Insulin. Molecular Pharmacology, 1993. 44(2): p. 271-276.
Cheng et al., "The Development of an Insulin-based Prodrug," APS poster presentation, 2011.
Chia et al., "Exogenous glucose-dependent insulinotropic polypeptide worsens post-prandial hyperglycemia in type 2 diabetes," Diabetes, 58: 1342-1349 (2009).
Cloutier, et al, "Low-energy (3-24eV) electron damage to the peptide backbone" J Phys Chem B. 111(7), p. 1620-1624 (Feb. 22, 2007).
Coffman et al., "Insulin-metal ion interactions: the binding of divalent cations to insulin hexamers and tetramers and the assembly of insulin-hexamers," Biochemistry, Aug. 9, 1988, vol. 27, No. 16, pp. 6179-6187.
Collie et al., "Purification and sequence of rat oxyntomodulin," Proc. Natl. Acad. Sci. USA, vol. 91, pp. 9362-9366, Sep. 1994.
Coy et al, J of Medicinal Chemistry, 1973, vol. 16, No. 7, 827-829.
Day et al., "A new glucagon and GLP-1 co-agonist eliminates obesity in rodents", Nature Chemical Biology (2009), 5(10), 749-757.
Day, J.; Patterson, J.; Gelfanov, V. and DiMarchi, Richard Molecular-basis for Specificity in Biological Action at the Homologous Glucagon and GLP-1 Receptors, (2009) Proceedings of the 21$^{st}$ American Peptide Society 142-143.
De, A. and DiMarchi, R. Synthesis & Analysis of Peptide Hormone-based prodrugs, (2009) Proceedings of the 21st American Peptide Society 160-161.
De, Design of peptide-based prodrug chemistry and its application to glucagon-like peptide 1. Masters Thesis Aug. 2007. [Retrieved from the Internet on Jun. 16, 2009: <https://scholarworksiu.edu/dspace/browse?value=De%2C+ArnabBtype=author>]; p. 8, para 2; p. 16, para 3; p. 40, para 1; p. 66, para 2; p. 77, para 1-2; p. 79, para 1.

De, et al., "Investigation of the feasibily of an amide-based prodrug under physiological conditions," Int. J. Pept. Res. Ther., 14, pp. 255-262 (2008).
DiMarchi, "Peptides—Development of Prodrug Chemistry," RBF Symposium Feb. 1-4, 2011 India.
DiMarchi, Richard, "The Use of Bioproducts in the Treatments of Metabolic Diseases" presentation slides for the Keystone Symposia (Jan. 25, 2009, Banff, Alberta).
Drucker, "Glucagon Gene Expression in Vertebrate Brain," The Journal of Biological Chemistry, vol. 263, No. 27, pp. 13475-13478, 1988.
Drucker, "The biology of incretin hormones," Cell Metabolism 3:153-165 (2006).
Du et al., "Biochemistry and Molecular Biology International," vol. 45, No. 2, Jun. 1, 1998, pp. 255-260 XP008147747.
Du X et al, Hydroxyl group of insulin A19Tyris essential for receptor binding: studies on (A9Phe) insulin, BioChem and Mol Biology International, Academic Press, Lindon, GB vol. 45, No. 2, Jun. 1, 1998, pp. 255-260. found in extended EP search report 09837982.9 (08055; 216442).
Eriksson et al., "hPEPT1 Affinity and Translocation of Selected Gln-Sar and Glu-Sar Dipeptide Derivatives", Molecular Pharmaceutics vol. 2, No. 3: 242-249 (May 10, 2005).
Evans et al., "Effect of β-Endorphin C-Terminal Peptides on Glucose Uptake in Isolated Skeletal Muscles of the Mouse," Peptides, vol. 18, No. 1, pp. 165-167, (1997).
Extended European Search Report, European Application No. 14773636.7-1402 / 2970511 PCT/US2014/020801, dated Feb. 22, 2016.
Finan, B.; Gelfanov, V. and DiMarchi, R. Assessment of a Tat-Derived Peptide as a Vector for Hormonal Transport, (2009) Proceedings of the 21st American Peptide Society 321-322.
G. Rajpal et al, "Single Chain Insulins as Receptor Agonists", Molecular Endocrinology, vol. 23, No. 5, Feb. 19, 2009 p. 679-688.
Garcia-Aparicio et al., "Design and Discovery of a Novel Dipeptidyl-peptidase IV (CD26)-Based Prodrug Approach", J. Med. Chem. 49: 5339-5351 (2006).
Gelfanov, et al. , Discover and Structural Optimization of High Affinity Co-Agonists at the Glucagon and GLP-1 Receptors, Understanding Biology Using Peptides, Springer, pp. 763-764, Jun. 23, 2005.
GenBank entry AAH05278, Jul. 15, 2006 [http:www/ncbi.nim.nih.gov/protein/13528972>].
Gershonov et al, A Novel Approach for a Watter-Soluble long Acting Insulin Prodrug . . . , J. Med. Chem (2000) vol. 43, pp. 2530-2537.
Gysin et al., "Design and Synthesis of Glucagon Partial Agonists and Antagonists," Biochemistry, 25, (1986), pp. 8278-8284.
Habi, "Special Issue: Program and Abstracts for the 19th American Peptide Symposium, 2005, Abstracts of Poster Section C," (pp. 574-603) Article first published online: Jun. 10, 2005 | DOI: 10.1002/bip.20325.
Hamel et al "Cyclosporin a prodrugs: Design, systhesis and biophysical properties", J. Peptide Research, vol. 63 No. 2 pp. 147-154 (Feb. 2004).
Han et al., "IGF-based Insulin Analogs with an A-Chain Lactam," APS poster presentation, 2011.
Han et al., "Structure-Activity Relationship of Insulin at Position A$^{19}$," APS poster presentation.
Hansen et al., "Incretin hormones and insulin sensitivity," Trends in Endocrinology and Metabolism, vol. 16, No. 4, May/Jun. 2005, pp. 135-136.
Harris, J. Milton, Final Word: PEGylation—A "Sunset" Technology? <http://licence.icopyright.net/user/viewFreeUse.act?fuid=OTU1NjY3OA%3D%3D>, BioPharm International, Jun. 1, 2004.
Hinds et al, Advancec Drug Delivery Reviews 2002, (54) 505-530 (Jun. 17, 2002).
Hiroshi Ogawa et al "N-Methylation of sleeted peptide bonds on the biological activity of insulin", International J of Peptide and Protein Research, vol. 30, No. 4, p. 460-473 (Oct. 1987).
Hjorth et al., "glucagon and Glucagon-like Peptide 1: Selective Receptor Recognition via Distinct Peptide Epitopes," The Journal of Biological Chemistry, vol. 269, No. 48, pp. 30121-30124, Dec. 2, 1994.

(56) References Cited

OTHER PUBLICATIONS

Hruby et al., "The Design and Biological Activities of Glucagon Agonists and Antagonists, and Their Use in Examining the Mechanisms of Glucose Action," *Curr. Med. Chem.-Imm., Endoc. & Metab. Agents*, 2001, 1, pp. 199-215.

Hua et al, J of Bilogical Chemistry, Mar. 2008, vol. 283, No. 21, 14703-14716 (May 23, 2008).

Irwin et al., "Early administration of the glucose-dependent insulinotropic polypeptide receptor antagonist ($Pro^3$) GIP prevents the development of diabetes and related metabolic abnormalities associated with genetically inherited obesity in ob/ob mice," Diabetologia 50:1532-1540 (2007).

Jen Holst "The Physiology of Glucagon -like Peptide -1", Physiological Reviews, v. 87, No. 4, pp. 1409-1439 (Oct. 2007).

Joost, H.G., et al., Quantitative Dissociation of Glucose-Transport Stimulation and Insulin-Receptor Tyrosine Kinase Activation in Isolated Adipocytes with a Covalent Insulin Dimer (B29,B29'-Sunberoyl-Insulin). Biochemical Pharmacology, 1989. 38(14): p. 2269-2277.

Joshi et al, "Studies on the Mechanism of Aspartic Acid Cleavage and Glutamine Deamidation in the Acidic Degradation of Glucagon," *Journal of Pharmaceutical Sciences*, vol. 94, No. 9, Sep. 2005, pp. 1912-1927.

Joshi et al., "The Degradation Pathways of Glucagon in Acidic Solutions," *International Journal of Pharmaceutics*, 203 (2000), pp. 115-125.

Joshi et al., "The Estimation of Glutaminyl Deamidation and Aspartyl Cleavage Rates in Glucagon," *International Journal of Pharmaceutics*, 273 (2004), pp. 213-219.

Kaur et al., "Novel Single Chain Insulin Analogs Consisting of a Non-Peptide Based Connection," APS poster presentation, May 12, 2011.

Kristensen et al., "Alanine Scanning Mutagenesis of Insulin," The Journal of Biological Chemistry, 1997, 272(20):12978-12983.

Krstenansky et al., "Importance of the C-terminal α-helical structure for glucagon's biological activity," Int. J. Peptide Protein Res., 32, 1988, 468-475.

Kukuch, A.; Patterson, J.; DiMarchi, R. and Tolbert, T. Immunoglobulin Fc-based Peptide Fusion Proteins as a Basis for Optimizing in Vivo Pharmacology, (2009) Proceedings of the $21^{st}$ American Peptide Society 177-178.

Kulkarni, "GIP: No Longer the Neglected Incretin Twin?," Science Translational Medicine 2(49): p. 47, Sep. 15, 2010.

Kurapkat et al "Inactive conformation of an insulin despite its wild-type sequence", Protein Science, vol. 6, No. 3, pp. 580-587 (Mar. 1997).

Lee et al., "Synthesis, Characterization, and Pharmacokinetic Studies of PEGylated Glucagon-like Peptide-1," *Bioconjugate Chem.*, 2005, vol. 16, No. 2, pp. 377-382.

Levy et al., Optimization of the C-terminal Sequence in Glucagon to Maximize Receptor Affinity, *Understanding Biology Using Peptides*, American Peptide Society, Apr. 2006.

Li et al., Crystallization and preliminary X-ray analysis of antiobesity peptide hormone oxyntomodulin, *Protein & Peptide Letters*, 15(2): 232-4 (2008).

Li et al., Design, synthesis and crystallization of a novel glucagon analog as a therapeutic agent, *Acta Crystallogr. Sect. F Struct. Biol. Cryst. Commun.*, 63(Pt 7):599-601, Jun. 15, 2007.

Li et al., Structural Basis for Enhanced Solublity of a C-Terminally Extended Glucagon Analog , *Biopolymers.*, 96(4): 480 (2011).

M.J. Roberts et al., "Chemistry for Peptide and Protein PEGylation," Advance Drug Delivery Reviews, Elsevier BV, Amsterdam, NL, vol. 54, No. 4, Jun. 17, 2002, pp. 459-476.

Ma, T.; Day, J.; Gelfanov, V. and DiMarchi, R. Discovery and Structural Optimization of High Affinity Co-Agonists at the Glucagon and GLP-1 Receptors, (2009) Proceedings of the $21^{st}$ American Peptide Society 146-147.

Madsen et al., "Structure—Activity and Protraction Relationship of Long-Acting Glucagon-like Peptide-1 Derivatives: Importance of Fatty acid Length, Polarity, and Bulkiness," J. Med. Chem. 2007, 50, pp. 6126-6132.

Marita P. Feldkaemper et al., "Localization and Regulation of Glucagon Receptors in the Chick Eye and Preproglucagon and Glucagon Receptor Expression in the Mouse Eye," Experimental Eye Research, Academic Press Ltd., London, vol. 79, No. 3, Sep. 1, 2004, pp. 321-329.

Mayer et al., Insulin Structure and Function, Peptide Science 2007, 88(5):687-713.

McKee et al., Receptor Binding and Adenylate Cyclase Activities of Glucagon Analogues Modified in the N-Terminal Region, Biochemistry, 25: 1650-6 (1986).

Montrose-Rafizadeh et al., "High Potency Antagonists of the Pancreatic Glucagon-like Peptide-1 Receptor," Journal of Biological Chemistry, 272(34) 21201-21206 (1997).

Murphy, et al., "Potent Long-Acting Alkylated Analogs of Growth Hormone-Releasing Factor," Pept. Res., vol. 1. No. 1, pp. 36-41 (1988).

Nogueiras et al., Direct control of peripheral lipid deposition by CNS GLP-1 receptor signaling is mediated by the sympathetic nervous system and blunted in diet-induced obesity, J. Neurosci., 29(18): 5916-25, May 6, 2009.

O'Brien, Assay for DPPIV Activity using Homogenous, Luminescent Method, Cell Notes 2005, 11:8-11. (http://www.promega.com/resources/articles/pubhub/cellnotes/assay-for-dppiv-activity-using-a-homogeneous-luminescent-method/).

Ouyang et al., "Synthesis and Characterization of Peptides with Glucagon Antagonism and GLP-1 Agonism," poster presentation at the $21^{st}$ American Peptide Symposium (Jun. 7-12, 2009, Bloomington, IN).

Ouyang et al., Discovery of Bi-Functional Peptides Balanced in Glucagon Antagonism & GLP-1 Agonism. A Search for the Molecular Basis in the Inversion of Activity at Homologous Receptors, 71st Scientific sessions of American Diabetes Association 2011—Post-Conference Review and Analysis.

Pan et al., "Synthesis of Cetuximab-Immunoliposomes via a Cholesterol-Based Membrane Anchor for Targeting of EGFR," Bioconjugate Chem., 18, pp. 101-108, 2007.

Pan et al., Design of a Long Acting Peptide Functioning as Both a Glucagon-like Peptide-1 Receptor Agonist and a Glucagon Receptor Agonist, *J. Biol. Chem.*, 281(18): 12506-15, Table 1, May 5, 2006.

Patterson et al., A novel human-based receptor antagonist of sustained action reveals body weight control by endogenous GLP-1, *ACS Chem Biol.*, 6(2): 135-45 Nov. 4, 2010.

Patterson et al., Functional association of the N-terminal residues with the central region in glucagon-related peptides, *J. Peptide Sci.*, First published online Jun. 10, 2011.

PCT International Search Report for PCT/US2009/068711 completed by the US Searching Authority dated Feb. 4, 2010.

PCT International Search Report for PCT/US2009/068712 completed by the US Searching Authority dated Mar. 24, 2010.

PCT International Search Report for PCT/US2009/068713.

PCT International Search Report for PCT/US2011/041601 completed by the US Searching Authority dated Nov. 10, 2011.

Perret et al., "Mutational analysis of the glucagon receptor: similarities with the vasoactive intestinal peptide (VIP)/pituitary adenylate cyclase-activating peptide (PACAP)/secretin receptors for recognition of the ligand's third residue," J. Biochem., 362 (2002), pp. 389-394.

Phillips et al., "Supramolecular protein engineering: design of zinc-stapled insulin hexamers as a long acting depot," J. Biol. Chem., Apr. 16, 2010, vol. 285, No. 16, pp. 11755-11759.

Reuter, T. Y Diet-induced models or obesity and type 2 diabetes. Drug Discovery Today: Disease Models, vol. 4/1:3-8 (2007).

Robberecht, P. et al., "Receptor Occupancy and Adenylate Cyclase Activation in Rat Liver and Heart Membranes by 10 Glucagon Analogs Modified in Position 2, 3, 4, 25, 27 and/or 29," Regulatory Peptides, 21 (1988), 117-128.

(56) References Cited

OTHER PUBLICATIONS

Sapse et al., The Role of Sale Bridge Formation in Glucagon: An Experimental and Theoretical Study of Glucagon Analogs and Peptide Fragments of Glucagon, *Molec. Med.*, 8(5): 251-62, May 1, 2002.

Sato, H., "Enzymatic procedure for site-specific pegylation of proteins," Advanced Drug Delivery Reviews 54, pp. 487-504 (2002).

Schafmeister et al., "An All-Hydrocarbon Cross-Linking System for Enhancing the Helicity and Metaboli Stability of Peptides", *J. Am. Chem. Soc.* 122: 5891-5892 (2000).

Schilling et al., "Degradation of Insulin by Trypsin and Alphachymotrypsin," Pharmaceutical Research 1991, 8(6):721-727 (abstract).

Shechter et al, "Albumin-insulin conjugate releasing insulin slowly under physiologiacal conditions: a new concept for long-acting insulin", Bioconjugate Chemistry vol. 16, No. 4, p. 913-920 (Jul.-Aug. 2005).

Shechter et al, "Reversible pegylation of insulin facilitates its prolonged action in vitro", Eur. J. Pharm. And Biopharm. 70 (Apr. 7, 2008) p. 19-28.

Shojaee-Moradie, F., et al., Demonstration of a Relatively Hepatoselective Effect of Covalent Insulin Dimers on Glucose-Metabolism in Dogs. Diabetologia, 1995. 38(9): p. 1007-1013.

Stigsnaes et al., "Characterisation and Physical Stability of PEGylated Glucagon," *International Journal of Pharmaceutics*, 330 (2007), pp. 87-98.

Sturm et al., "Structure-Function Studies on Positions 17, 18, and 21 Replacement Analogues of Glucagon: The Importance of Charged Residues and Salt Bridges in Glucagon Biological Activity," J Med Chem 1998, 41, 2693-2700.

Suaifan et al., "Effects of steric bulk and stereochemistry on the rates of diketopiperazine formation from $N$-aminoacyl-2,2-dimethylthiazolidine-4-carboxamides (Dmt dipeptide amides)—a model for a new prodrug linker system," Tetrahedron 62, (2006), pp. 11245-11266.

Sueiras-Diaz et al., "Structure-Activity Studies on the N-Terminal Region of Glucagon," J. Med. Chem., 27, pp. 310-315, 1984.

Tatnell, M.A., et al., Evidence Concerning the Mechanism of Insulin-Receptor Interaction and the Structure of the Insulin-Receptor from Biological Properties of Covalently Linked Insulin Dimers. Biochemical Journal, 1983. 216(3): p. 687-694.

Traylor et al., Identification of the High Potency Glucagon Agonist with Enhanced Biophysical Stability and Aqueous Solubility, Poster Abstract PY 10, pp. 505-506, Jun. 10, 2005.

Trivedi, D. et al., Design and synthesis of conformationally constrained glucagon analogues, *J. Med. Chem.*, 43(9): 1714-22, May 4, 2000 (Abstract).

Tschoep et al., A Novel Glucagon/GLP-1 Co-Agonist Eliminates Obesity in Rodents, Diabetes, 58 (Supp. 1): A83 (2009).

Tschoep, "CNS Integration of Systems Metabolism: Target Opportunities for Diabetes Prevention and Therapy," RBF Symposium Feb. 1-4, 2011 India.

Unson et al., "Glucagon antagonists: Contribution to binding and activity of the amino-terminal sequence 1-5, position 12 and the putative alpha-helical segment 19-27," J. Biol. Chem. v264, pp. 789-794, Jan. 15, 1989, p. 792, para 1, Table 1.

Unson et al., "Role of Histidine-1 in Glucagon Action," Archives of Biochemistry and Biophysics, vol. 300, No. 2, pp. 747-750, Feb. 1, 1993.

Unson et al., Positively Charged Residues at Positions 12, 17, and 18 of Glucagon Ensure Maximum Biological Potency, *J. Biol. Chem.*, 273(17): 10308-12 (1998).

Vijayalakshmi et al., "Comparison of Helix-Stabilizing Effects of $\alpha$, $\alpha$-dialkyl Glycines with Linear and Cycloalkyl Side Chains", *Biopolymers* 53: 84-98 (Jan. 21, 2000).

Wang et al., "Identification of Site(s) of Insulin Nitration by Peroxynitrite and Characterization of its Structural Change," Protein & Peptide Letters 2008, 15:1063-1067.

Ward et al., In vitro and in vivo evaluation of native glucagon and glucagon analog (MAR-D28) during aging: lack of cytotoxicity and preservation of hyperglycemic effect, J. Diabetes Sci. Technol., 4(6):1311-21, Nov. 1, 2010.

Ward, "Fatty Acid Acylation of Peptides: Developing strategies to enhance medicines for treating metabolic disorders," Jan. 14, 2009.

Ward, B.; Finan, B.; Gelfanov, V. and DiMarchi, R. Exploring the N-terminal Hydrophobic Faces of Glucagon and Glucagon-like Peptide-1, (2009) Proceedings of the $21^{st}$ American Peptide Society 153-154.

Weiland et al, "Antagonistic effects of a covalenly dimerized insulin derivatized insulin derivative on insulin receptors in 3T3-L1 adipocytes", PNAS, vol. 87, pp. 1154-1158, Feb. 1990.

Wibowo, Synthesis, Purification , and Biological Activity of AIB Substituted Glucagon and GLP-1 Peptide Analogues (2005-2006) vol. 45, 707=738, accessed https://scholarworks.iu.edu/dspce/handle/2022/326 on Jul. 17, 2012.

Worrall et al "Synthesis of an organoinsulin molecule tha tcan be activated by antibody catalysis", PNAS vol. 98, No. 24, p. 13514-13518 (Nov. 20, 2001).

Wynne et al., "Subcutaneous Oxyntomodulin Reduces Body Weight in Overweight and Obese Subjects," *Diabetes*, vol. 54, Aug. 2005, pp. 2390-2395.

Yang et al, "Relationship between insulin a chain regions and insulin biological activities," World J. of Gastroentero, 2000: 6(3): 371-373 (Jun. 2000).

Yang et al., "A Novel Approach to Resin-Based Cysteine Alkylation," poster presentation to American Peptide Society, 2005.

Yang et al., "Synthesis and Biological Assessment of Sulfonic Acid-Based Glucagon Antagonists," American Peptide Society, 2005.

Yang et al., "Synthesis and Biological Assessment of Sulfonic Acid-Based Glucagon Antagonists," poster presentation to American Peptide Society, 2005.

Yang et al., Synthesis and Biological Assessment of Sulfonic Acid-Based Glucagon Antagonists, Understanding Biology Using Peptides, American Peptide Symposia, 9(Part 6): 305-6 (2006).

Yang, B. and DiMarchi, R.D. (2005). A Novel Approach to Resin-based Cysteine Alkylation Peptides: Chemistry, Structure and Biology, Proceedings of the XIX American Peptide Symposium, (88-89).

Zhang et al., Design and synthesis of novel GLP1 analogues with significantly prolonged time action, Biopolymers., 80(4): 555 (2005).

Zhao et al., "Improved Pharmacokinetics through Site-Specific PEGylation of Insulin Analogs," APS poster presentation, 2011.

Zhou et al., "Peptide and protein drugs: I. Therapeutic applications, absorption and parenteral administration," International Journal of Pharmaceutics vol. 75 p. 97-111 (Sep. 20, 1991).

Schuttler, A. and D. Brandenburg, Preparation and Properties of Covalently Linked Insulin Dimers. Hoppe-Seylers Zeitschrift Fur Physiologische Chemie, 1982. 363(3): p. 317-330.

Roth, R.A., et al., Effects of Covalently Linked Insulin Dimers on Receptor Kinase-Activity and Receptor down Regulation. Febs Letters, 1984. 170(2): p. 360-364.

Tatnell, M.A., R.H. Jones, and P.H. Sonksen, Covalently-Linked Insulin Dimers—Their Metabolism and Biological Effects Invivo as Partial Competitive Antagonists of Insulin-Clearance. Diabetologia, 1984. 27(1): p. 27-31.

Deppe, C., et al., Structure-Activity Relationship of Covalently Dimerized Insulin Derivatives—Correlation of Partial Agonist Efficacy with Cross-Linkage at Lysine B29. Naunyn-Schmiedebergs Archives of Pharmacology, 1994. 350(2): p. 213-217.

Höcker, H., C. Havenith, and D. Brandenburg, Covalently Bridged Insulin Dimers. 2009, EP Patent 1,161,452.

J. Vora, "Combining Incretin-Based Therapies With Insulin: Realizing the potential in type 2 diabetes", Diabetes Care, vol. 36, No. Supplement 2, Jul. 23, 2013.

Jain et al., "Mutual prodrugs containing bio-cleavable and drug releasable disulfide linkers", Bioorganic Chemistry, vol. 49, Aug. 1, 2013.

Finan et al., "Unimolecular Dual Incretins Maximize Metabolic Benefits in Rodents, Monkeys, and Humans", Science Translational Medicine, vol. 5, No. 209, Oct. 30, 2013.

(56) References Cited

OTHER PUBLICATIONS

Kaur et al., "Discovery of High Potency, Single-Chain Insulin Analogs with a Shortened B-Chain and Nonpeptide Linker", ACS Chemical Biology, vol. 8, No. 8, Aug. 16, 2013.
Chakradhar, "All in one: Researchers create combination drugs for diabetes and obesity", Nature Medicine, vol. 22, Jan. 1, 2016.
Extended European Search Report, European Application No. 15845481.9-1466/ 3206710, PCT/US2015051728, dated Nov. 21, 2017, 10 pages.

* cited by examiner

Insulin Receptor Activity of GLP-1/Insulin (DP8 fusion)

HAEGTFTSDVSSYLEEQAAREFIAWLVRGRG-GPENHLCGAHLVDALYLVCGDRGFYFNDRGAGSSSRRGIVDECCHRSCDLRRLENYCN

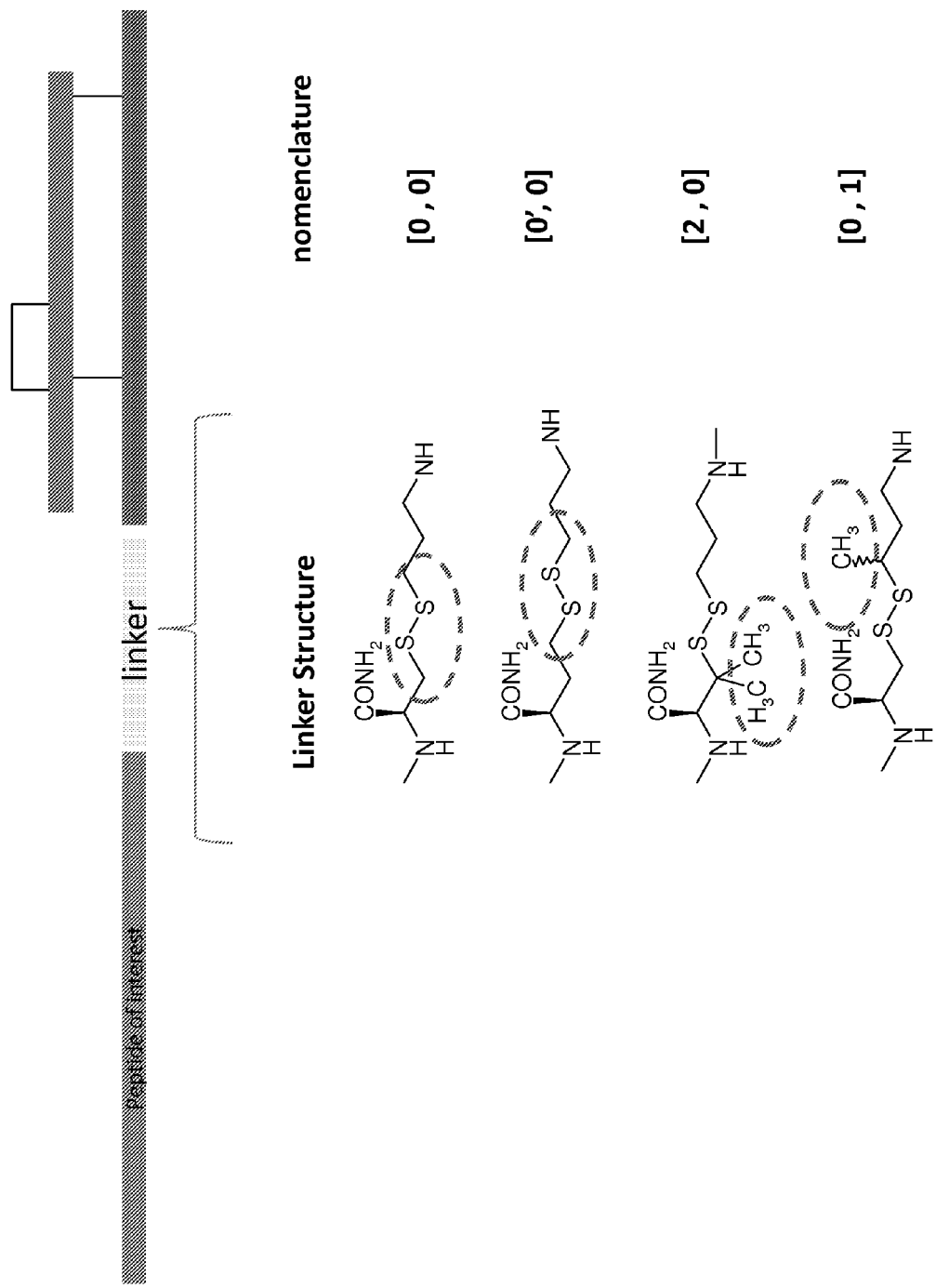
Fig. 2: Single Molecule incretin/insulinCo-agonists

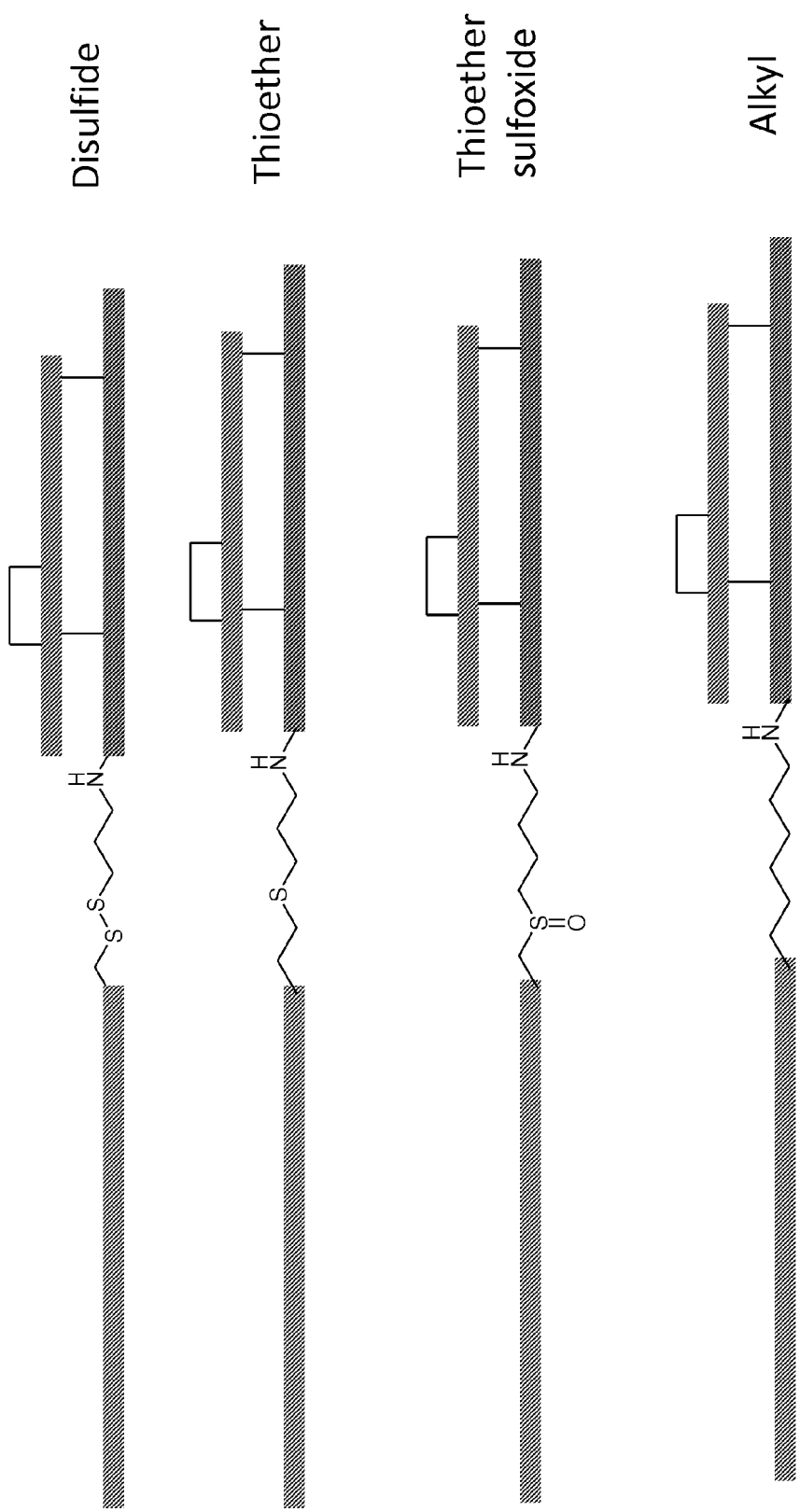

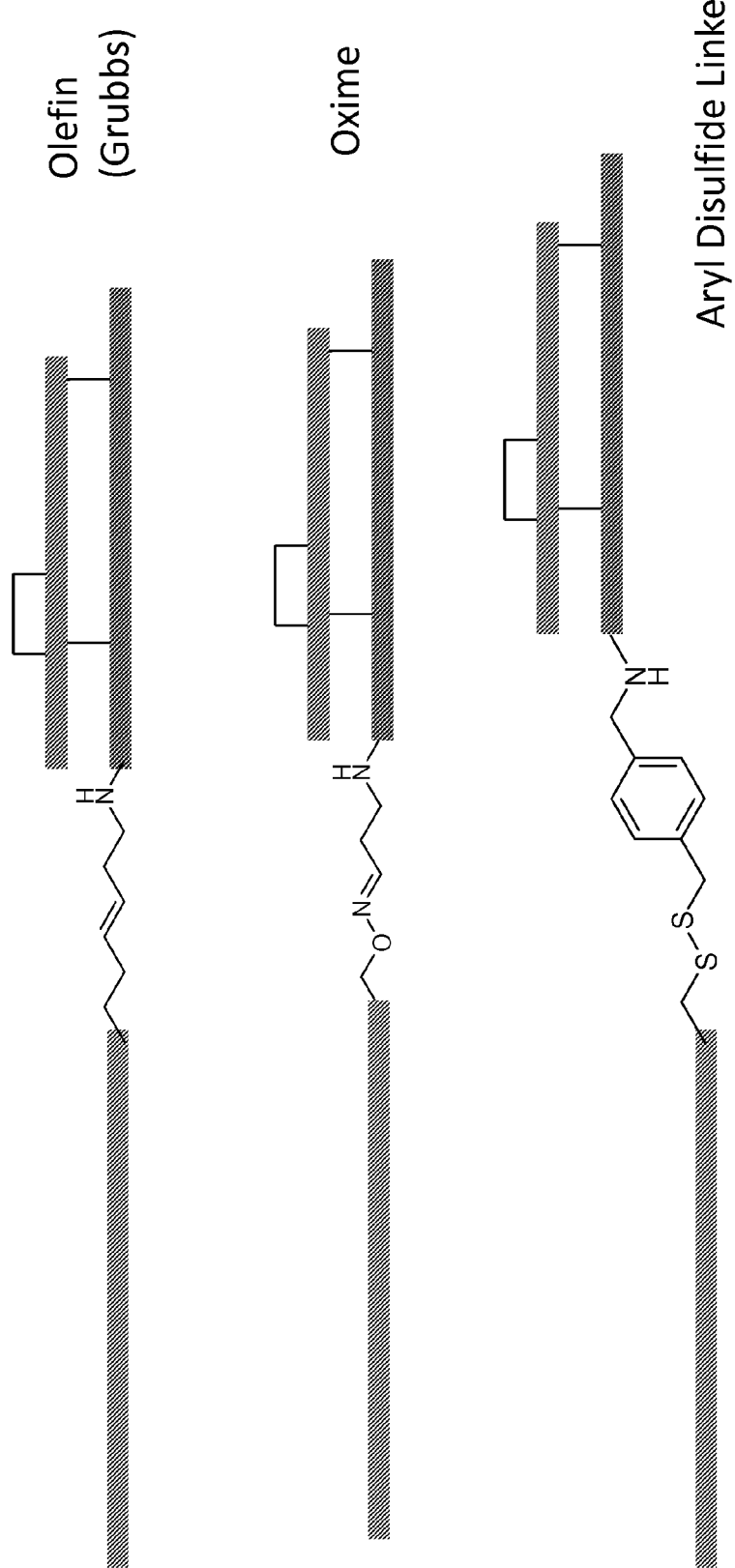

Synthesis of Increlin Co-agonists

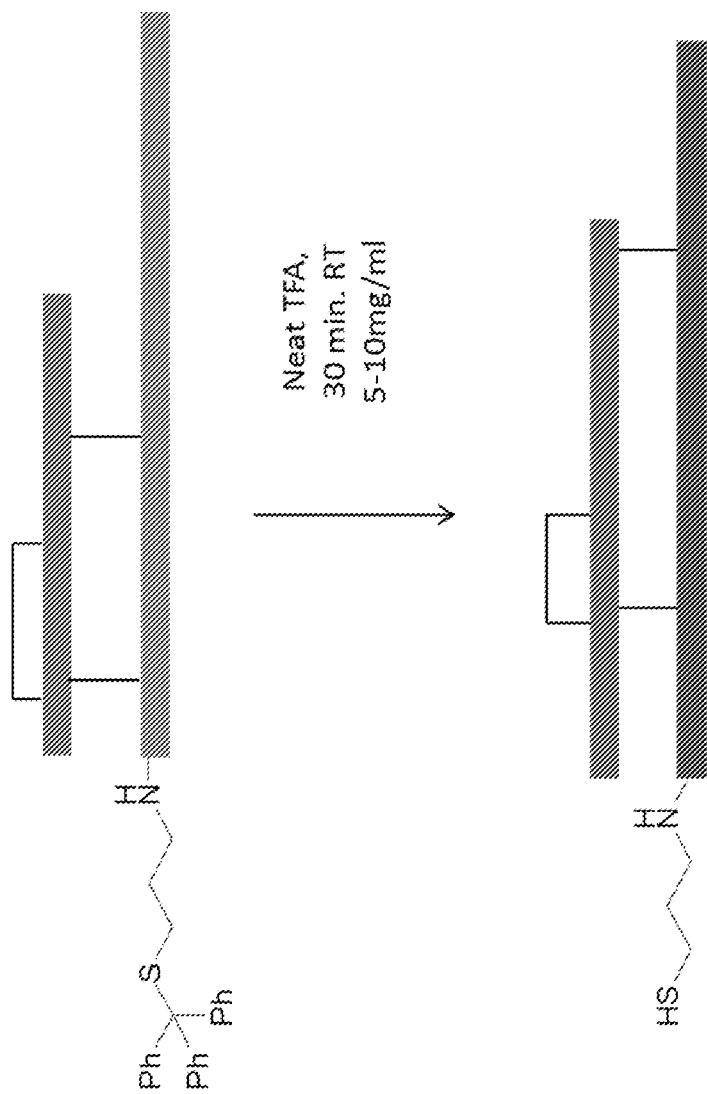

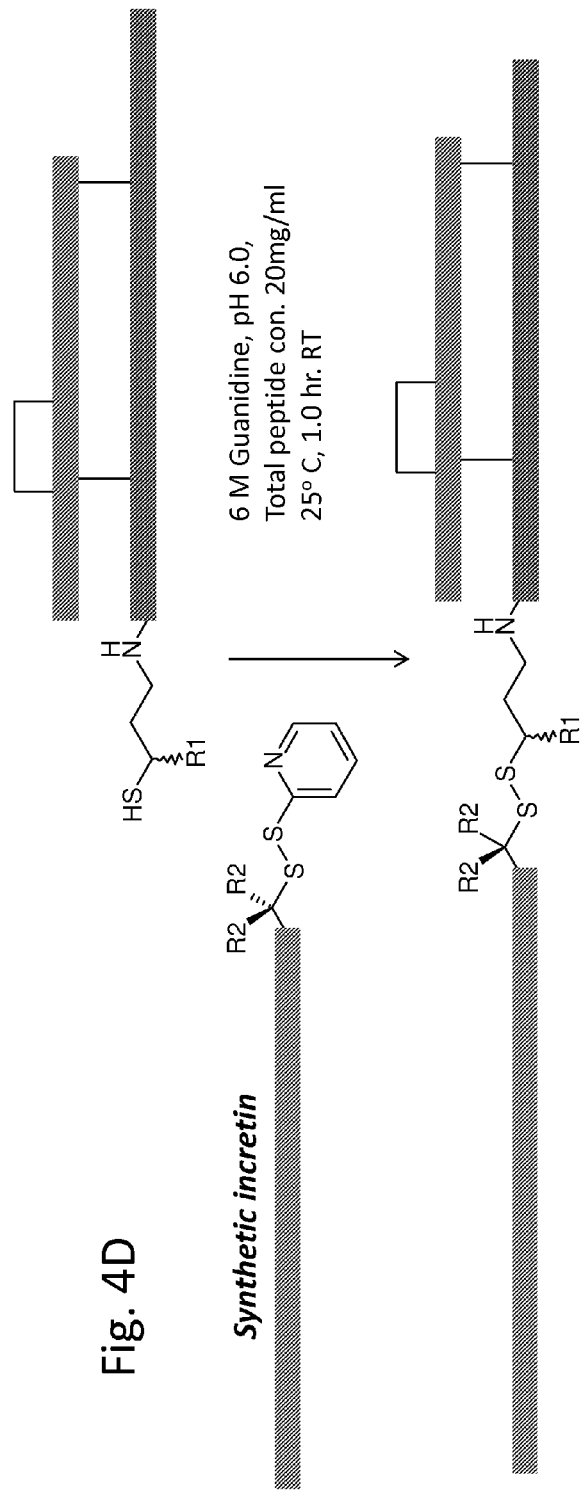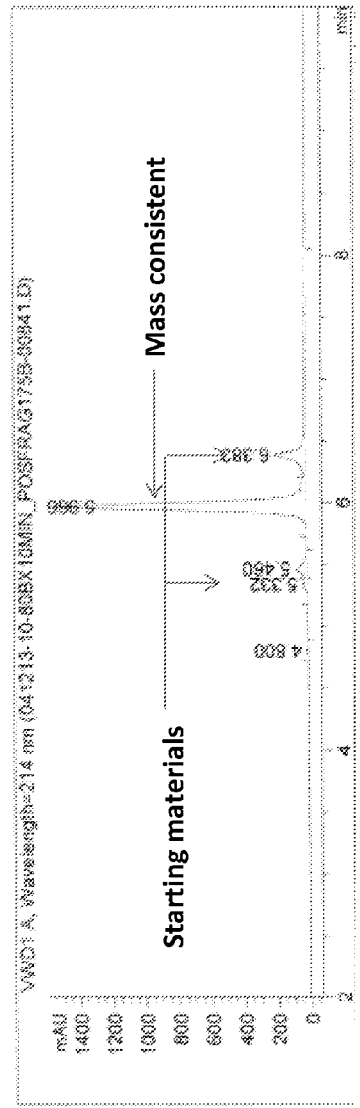
Fig. 4D *Synthesis of Incretin Co-agonists*

Fig. 5A & 5B: Insulin Receptor Isoform B Bioactivity of Increlins

GLP-1 & Glucagon Receptor Bioactivity of Increlins
Fig. 6A  GLP-1 Receptor
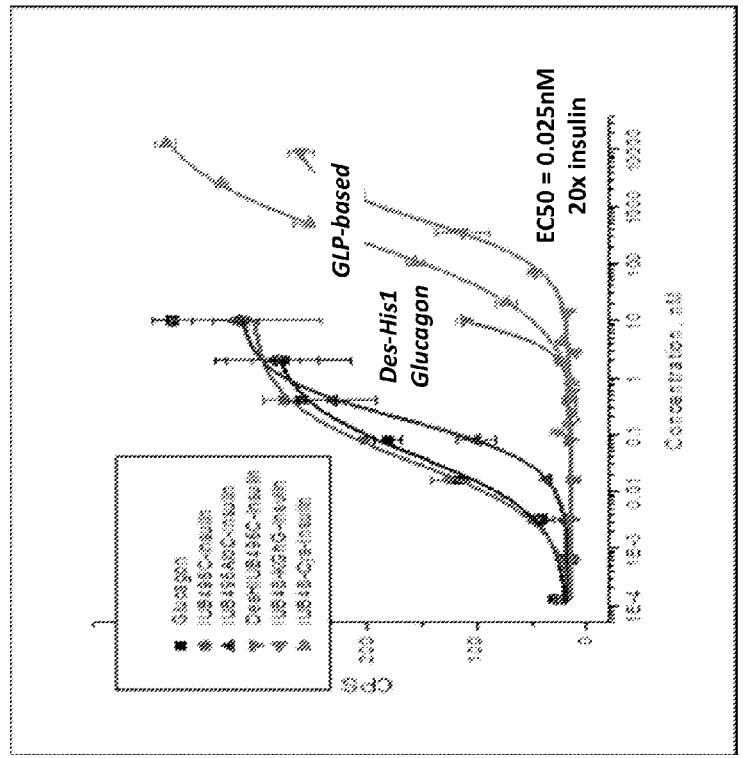
GLP increlin
Fig. 6B  Glucagon Receptor
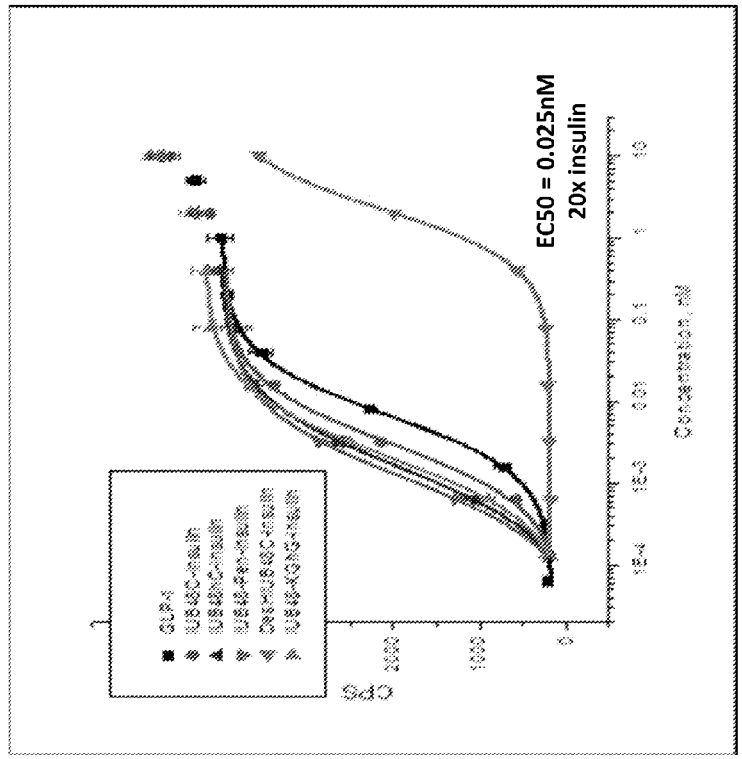
glucagon increlin

Fig. 7
*Relative Ex Vivo Stability in Diluted Plasma*
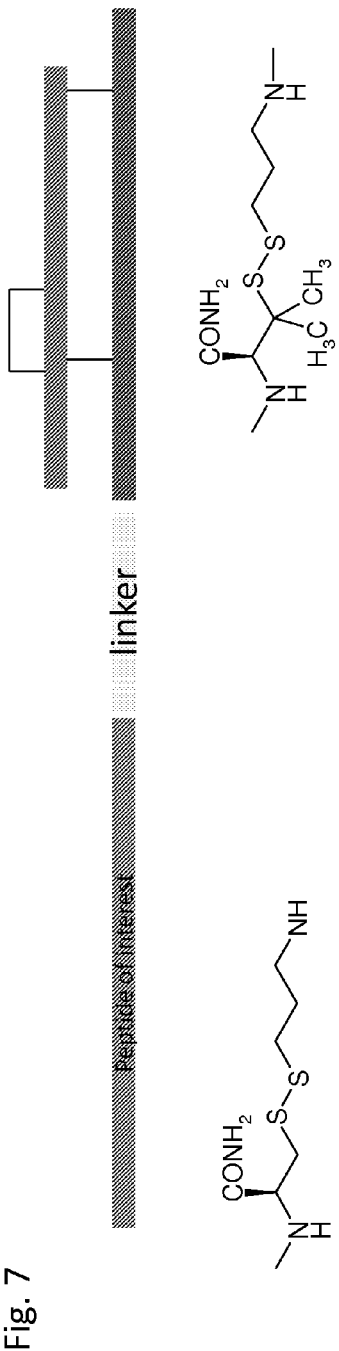
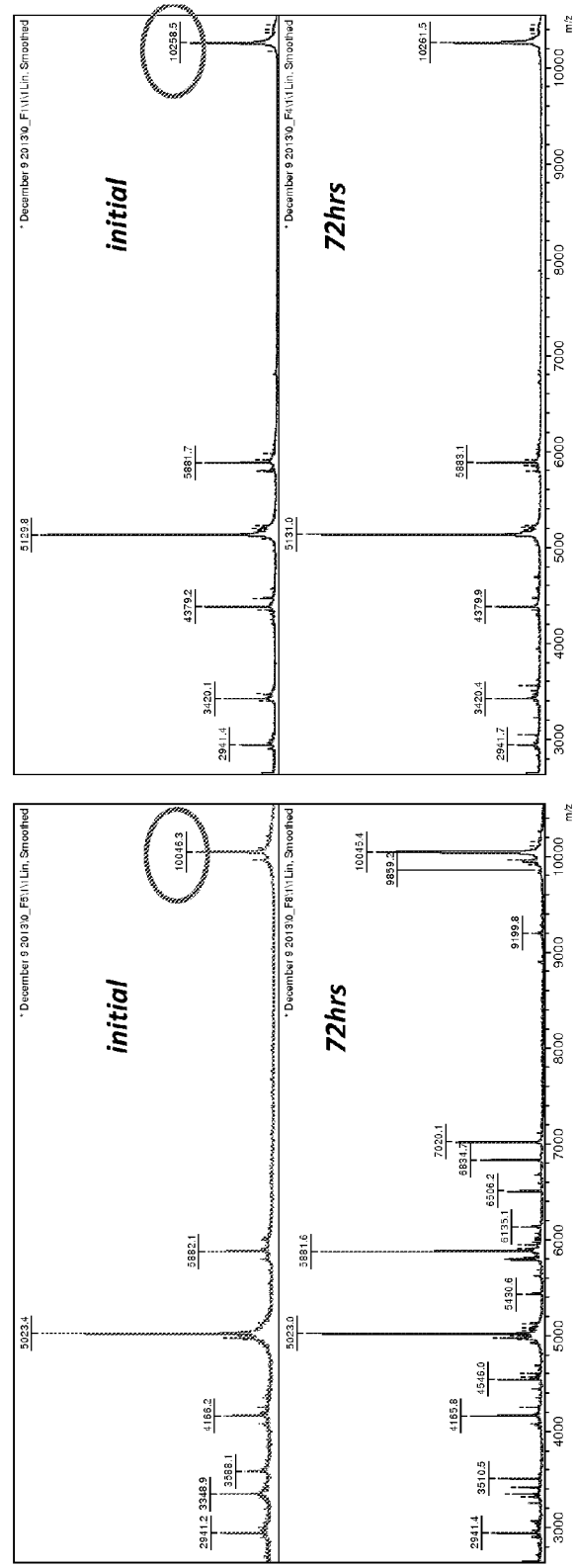

Fig. 8

Fig. 10A: Assembly of a Sustained Duration Analog

HXEGTFTSDVSSYLEEQAAREFIAWLVRGGPSSGAPPPSXC(S-S)-CH$_2$CH$_2$CH$_2$-B$^1$Insulin

HXEGTFTSDXSSYLEEQAAREFIAWLVRGGPSSGAPPPSC(S-S)-CH$_2$CH$_2$CH$_2$-B$^1$Insulin

HXEGTFTSDVSSYLEEQAAREFIAWLVRGGPSSGAPPPSC(S-S)-CH$_2$CH$_2$CH$_2$-B$^1$Insulin-X(LysB29)

HXEGTFTSDXSSYLEEQAAREFIAWLVRGGPSSGAPPPSXC(S-S)-CH$_2$CH$_2$CH$_2$-B$^1$Insulin

HXEGTFTSDVSSYLEEQAAREFIAWLVRGGPSSGAPPPSXC(S-S)-CH$_2$CH$_2$CH$_2$-B$^1$Insulin-X(LysB29)

Incretin X$^{10}$ $^{or}$ $^{40}$ or insulin B$^{29}$ can be pegylated (10 or 20kd), or γE—C16

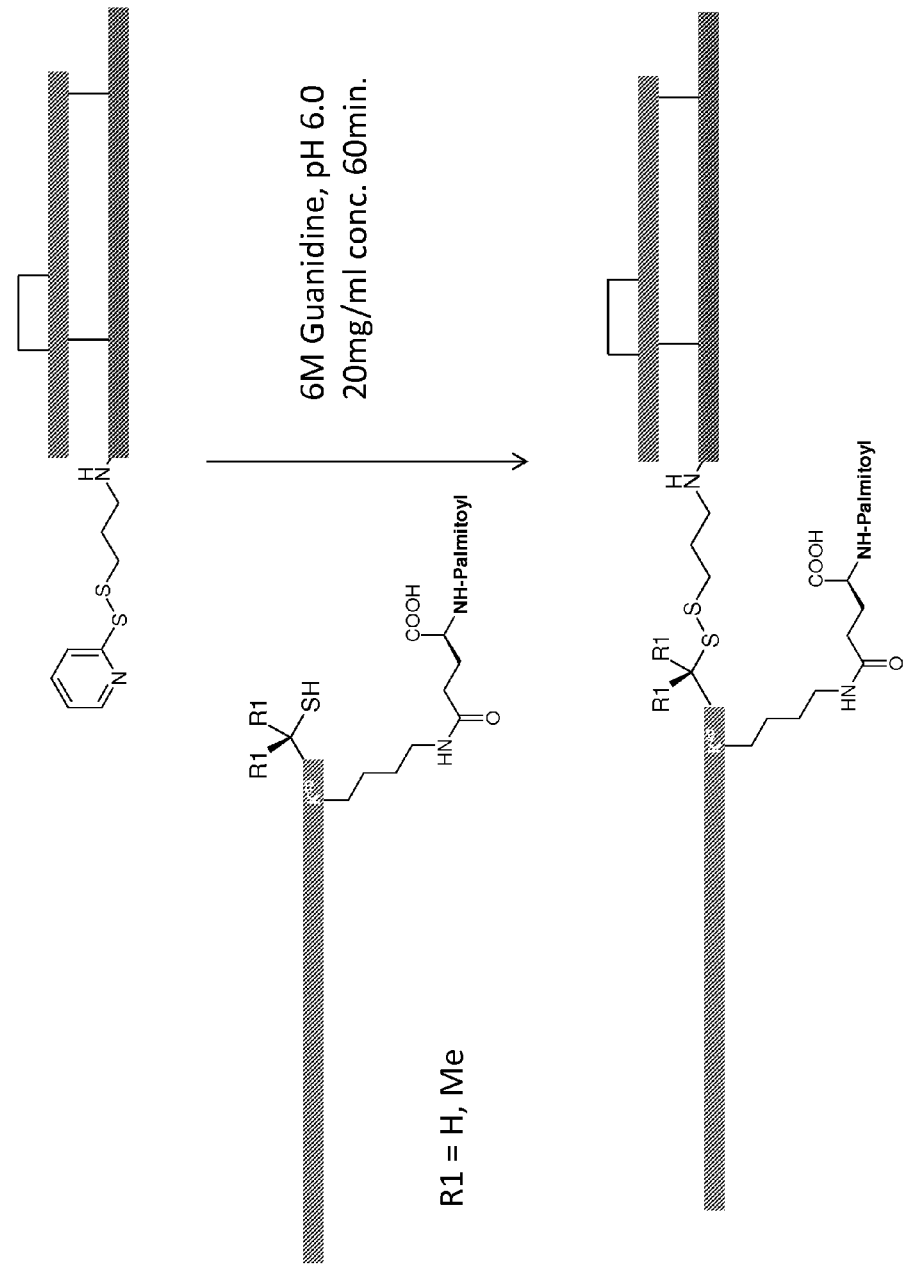

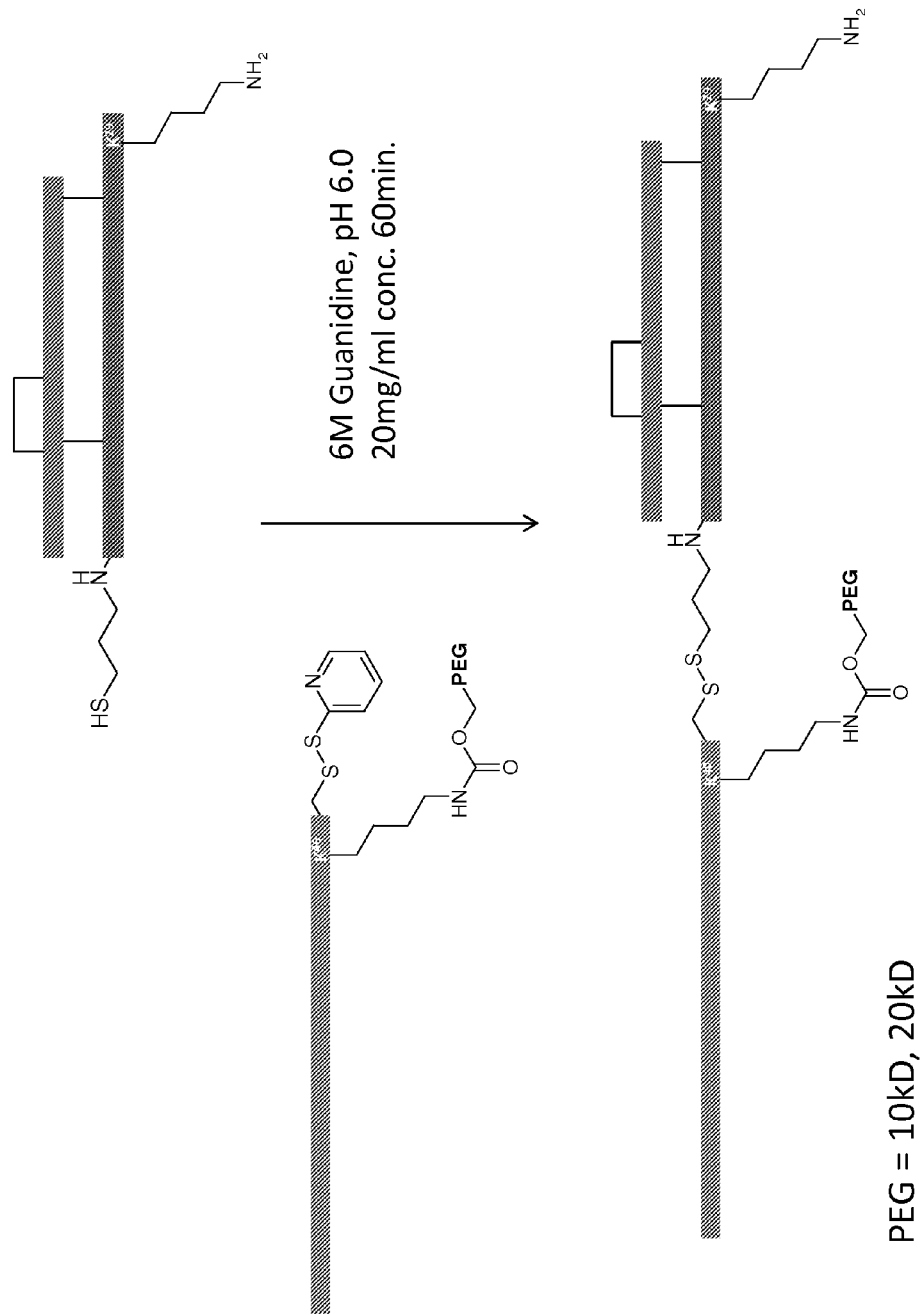

Fig. 10 D: Increlin Assay Results

|  | | GLP1-Rec | GIP-Rec | IN-Rec |
|---|---|---|---|---|
| Stds | | 0.025 | 0.025 | 0.5 |
| HXEGTFTSDVSSYLEEQAAKEFIAWLVKGGPSSGAPPPSC(S-S)—CH₂CH₂CH₂-B¹Insulin | CIU-001 | 0.012 | >10 | 0.356 |
| HXEGTFTSDK((fEC16))SSYLEEQAAKEFIAWLVKGGPSSGAPPPSGC(S-S)—CH₂CH₂CH₂-B¹Insulin | CIU 012 | 0.003 | >10 | 1.006 |
| HXEGTFTSDVSSYLEEQAAKEFIAWLVKGGPSSGAPPPSGK((fEC16))C(S-S)—CH₂CH₂CH₂-B¹Insulin | CIU 013 | 0.003 | 6.836 | 0.759 |

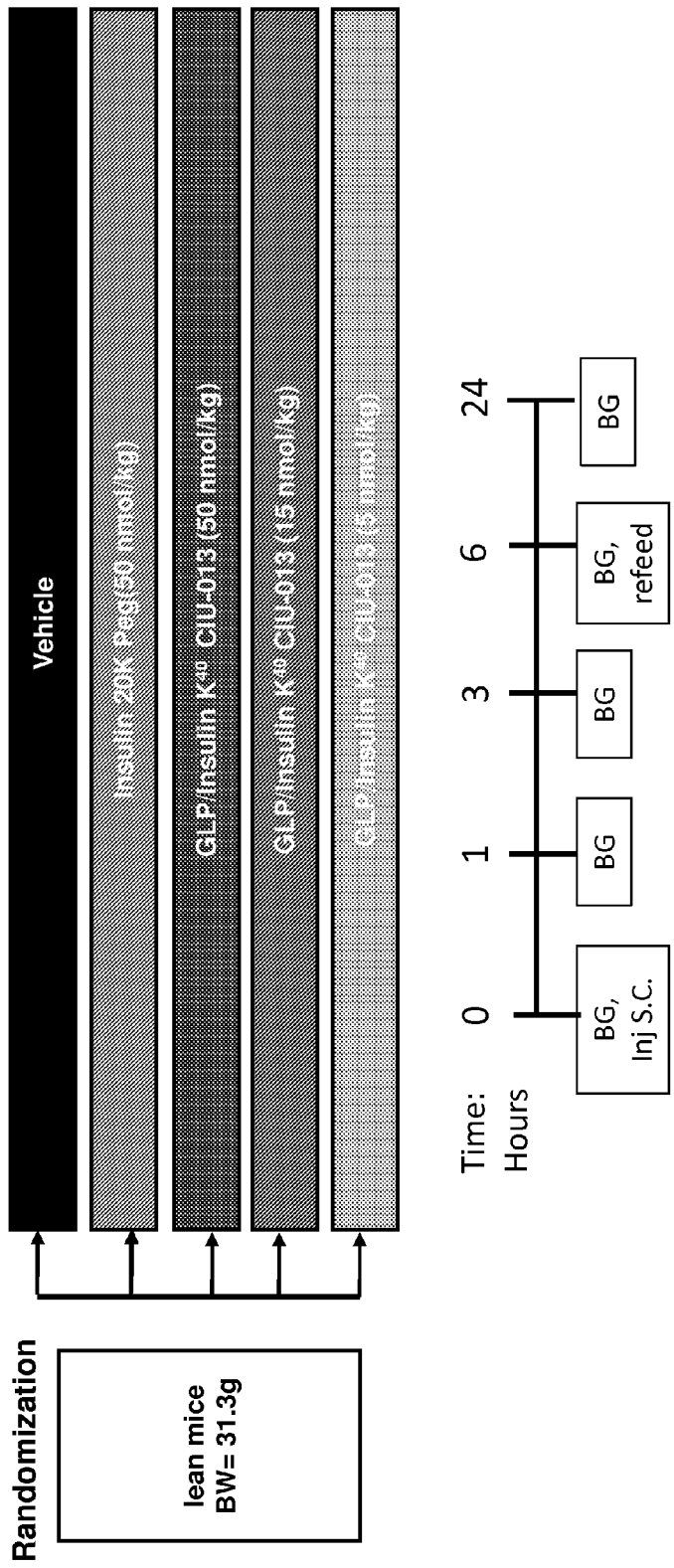
Fig. 11A: GLP-based Lipidated Increlin

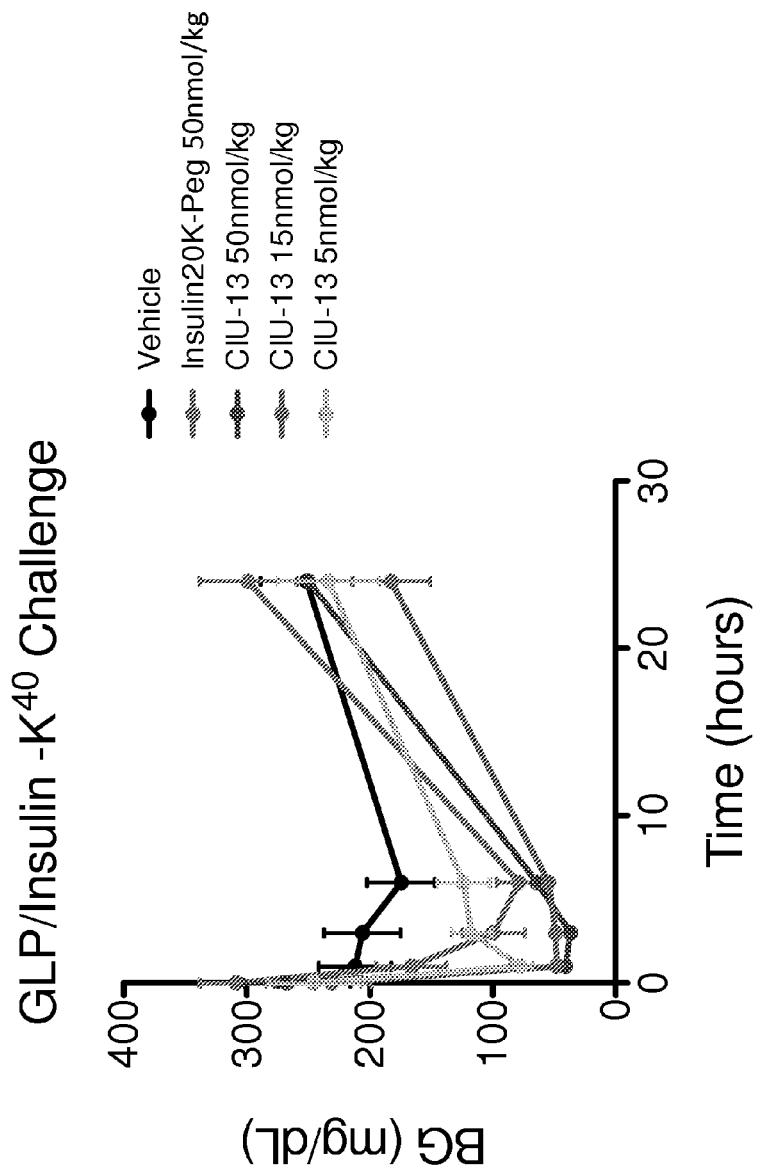

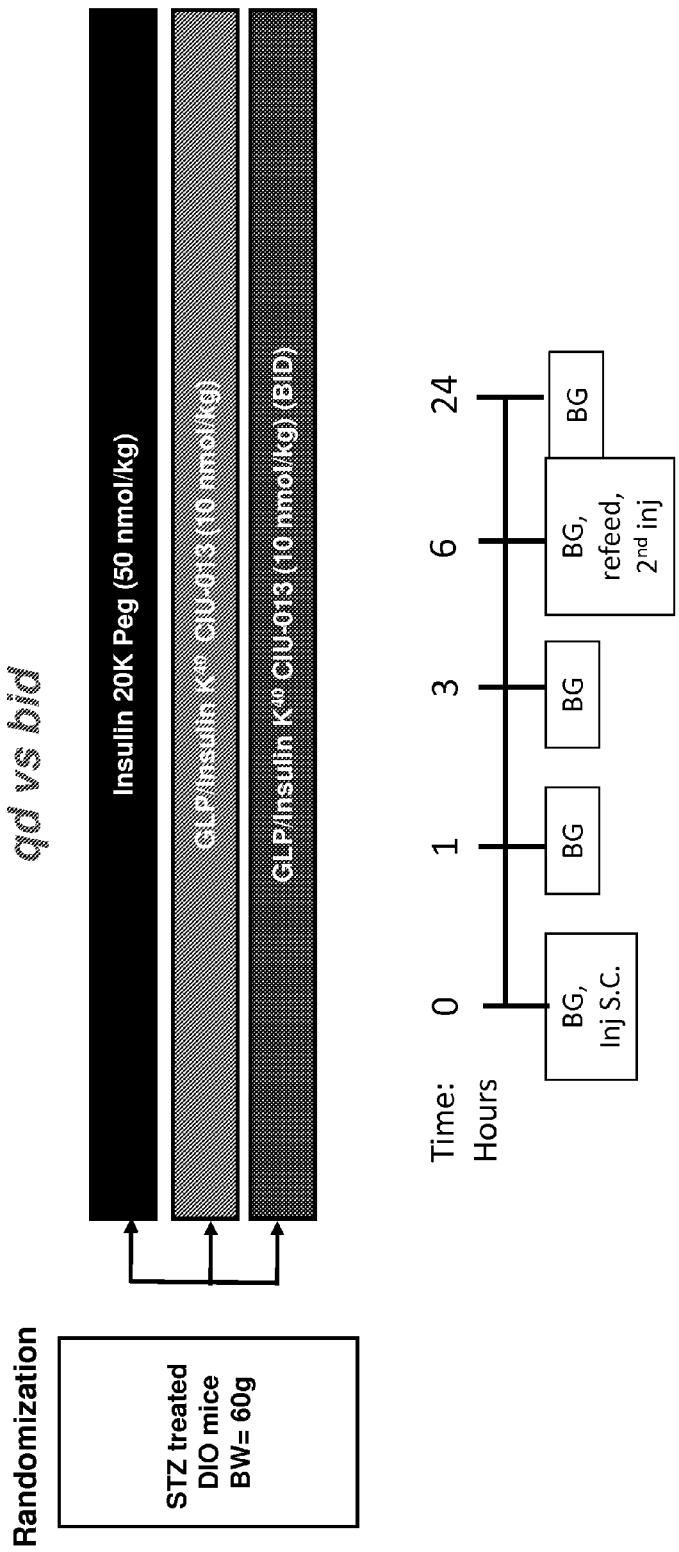

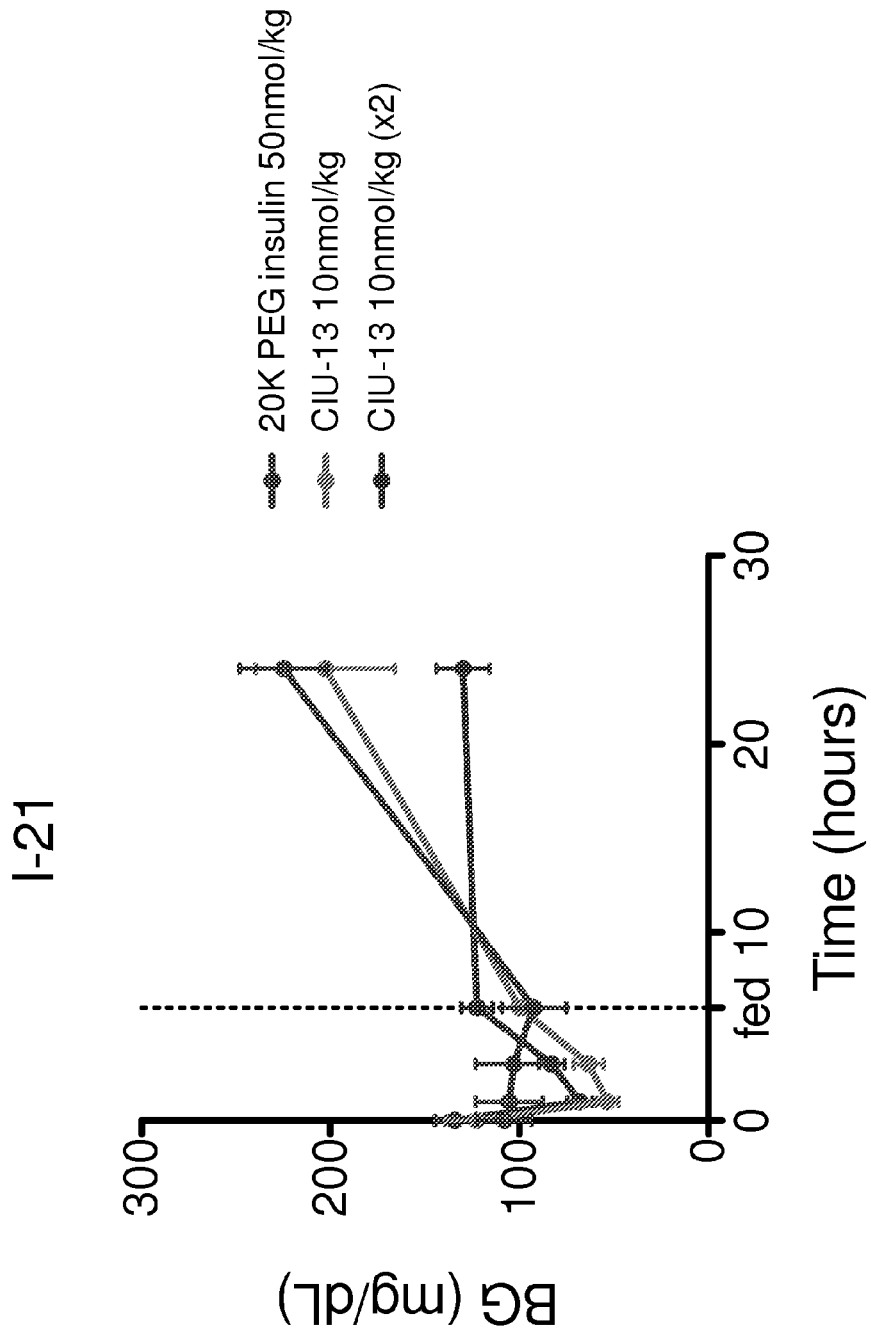

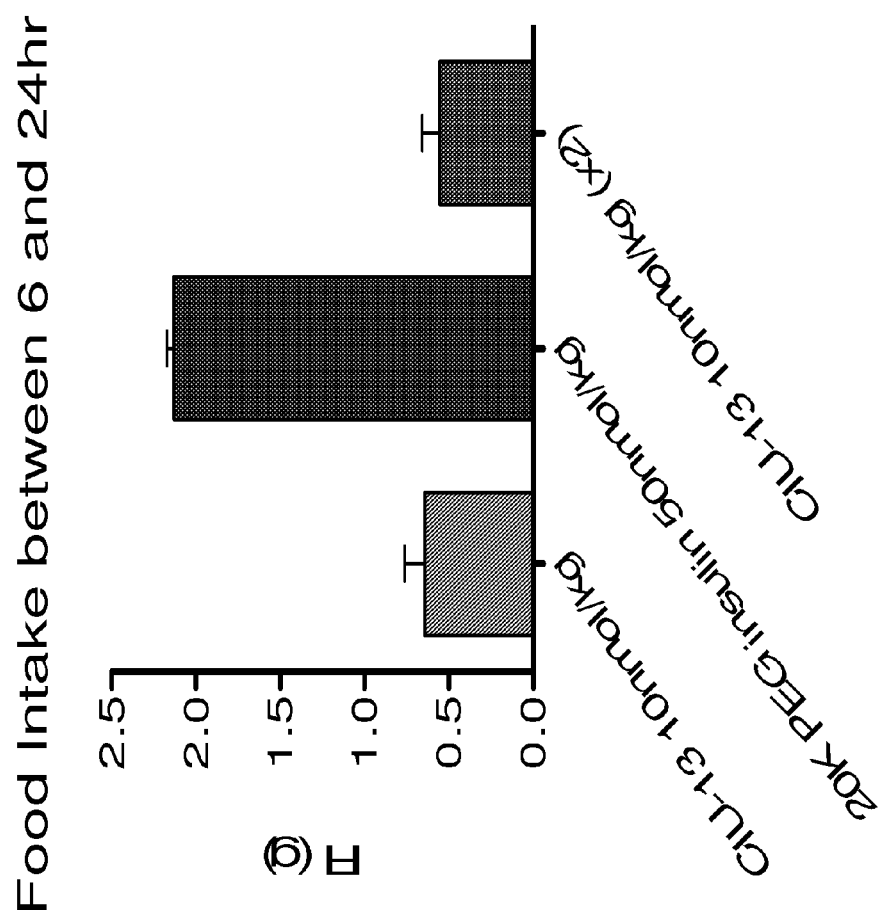
Fig. 13: GLP-based Increlin
qd vs bid

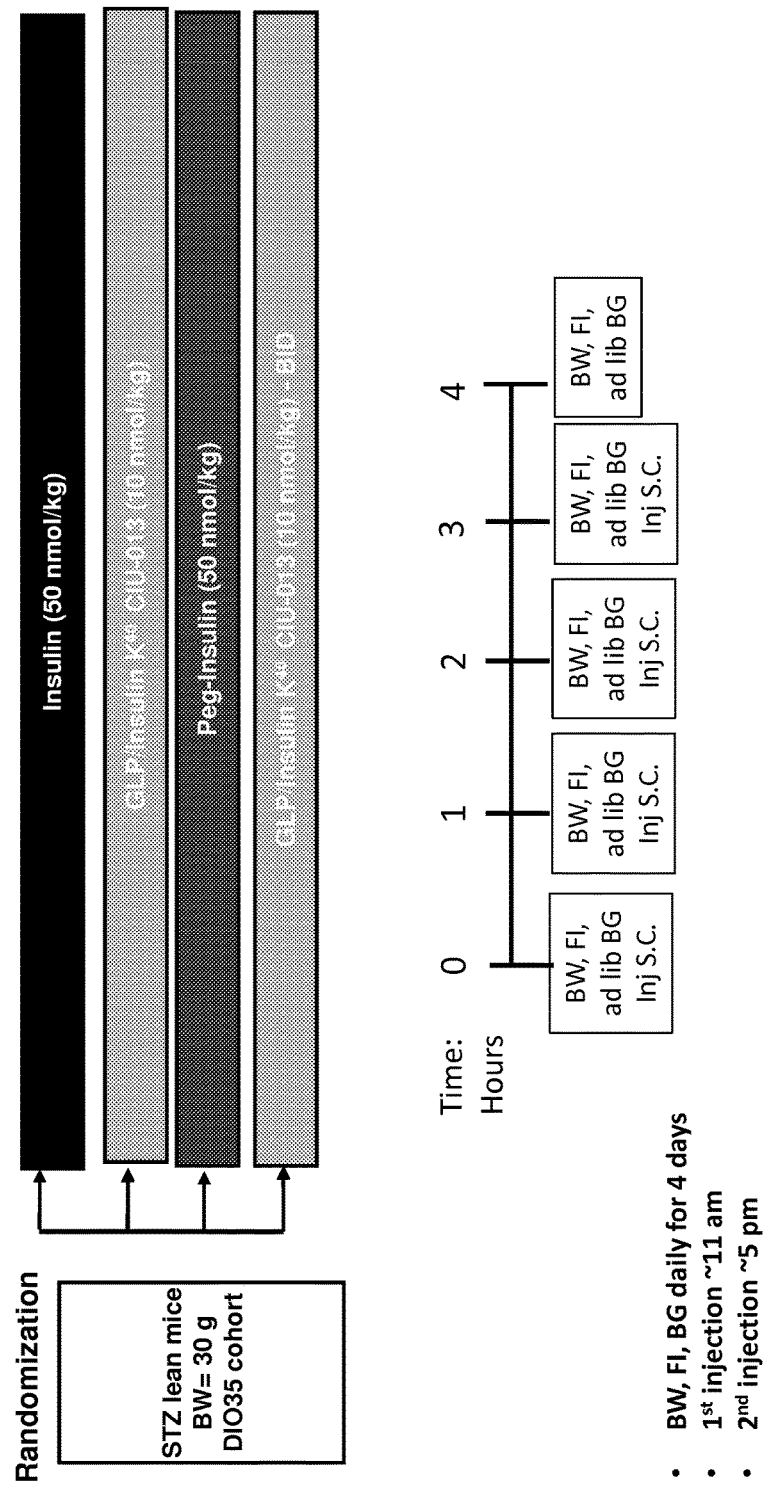

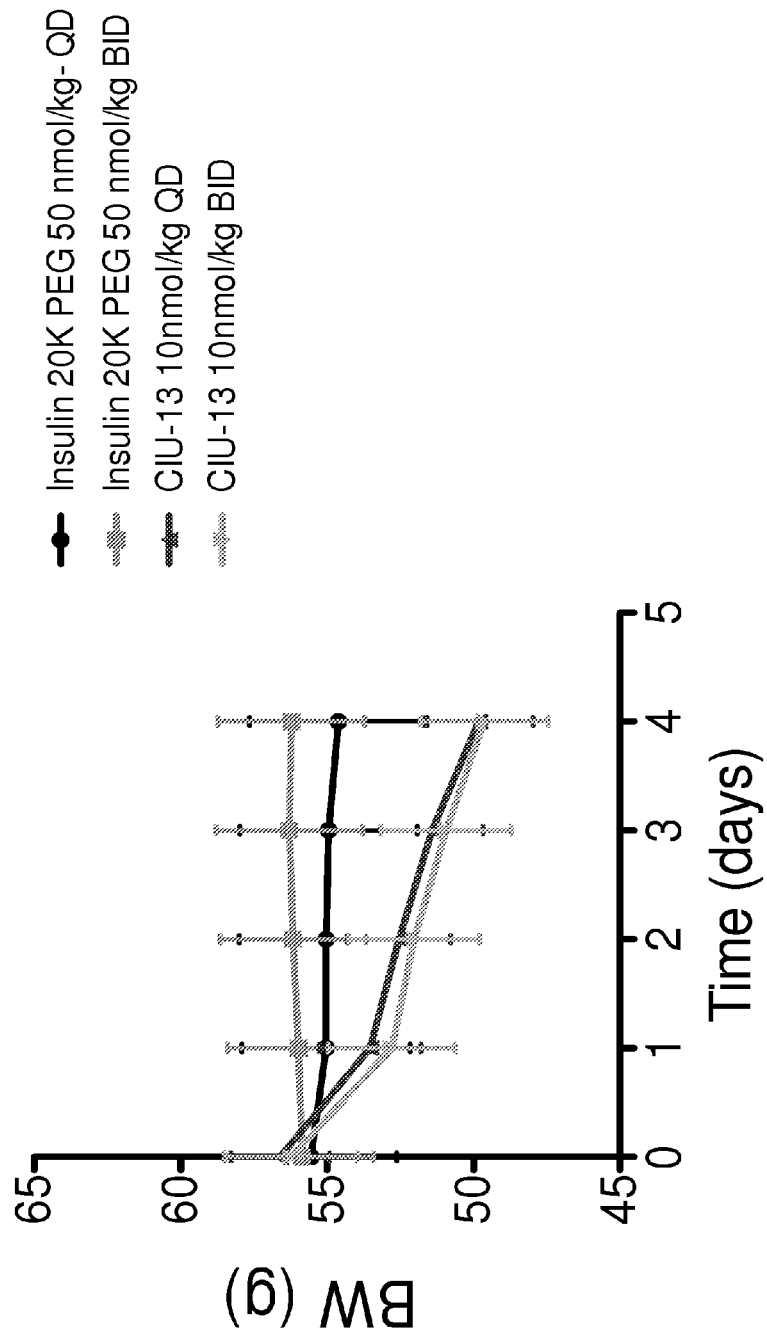
Fig. 14B: GLP-based Incretin
qd vs bid

Fig. 15B

GLP-based Lipidated Increlins

10 nmol/kg ITT

Legend: Vehicle -PBS, Insulin, CIU-12, CIU-13, CIU-21, CIU-22

X-axis: Time (Hours), 0 to 24
Y-axis: BG (mg/dL), 0 to 400

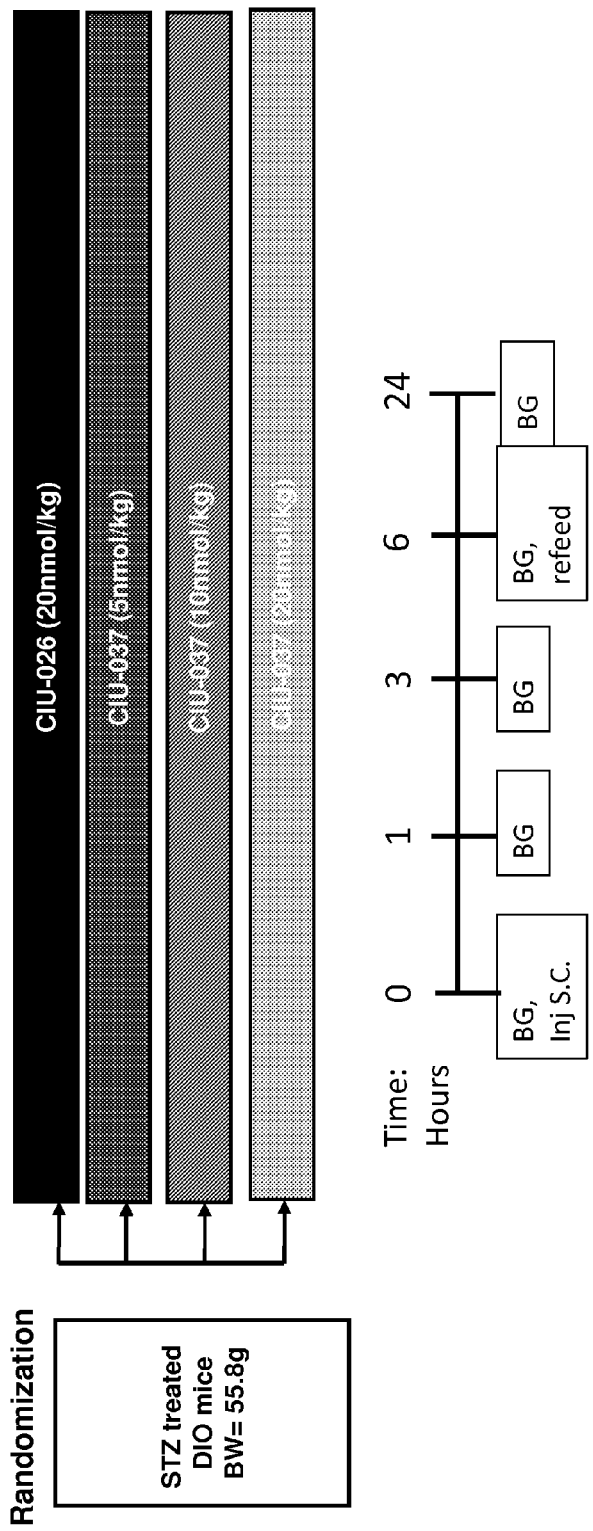

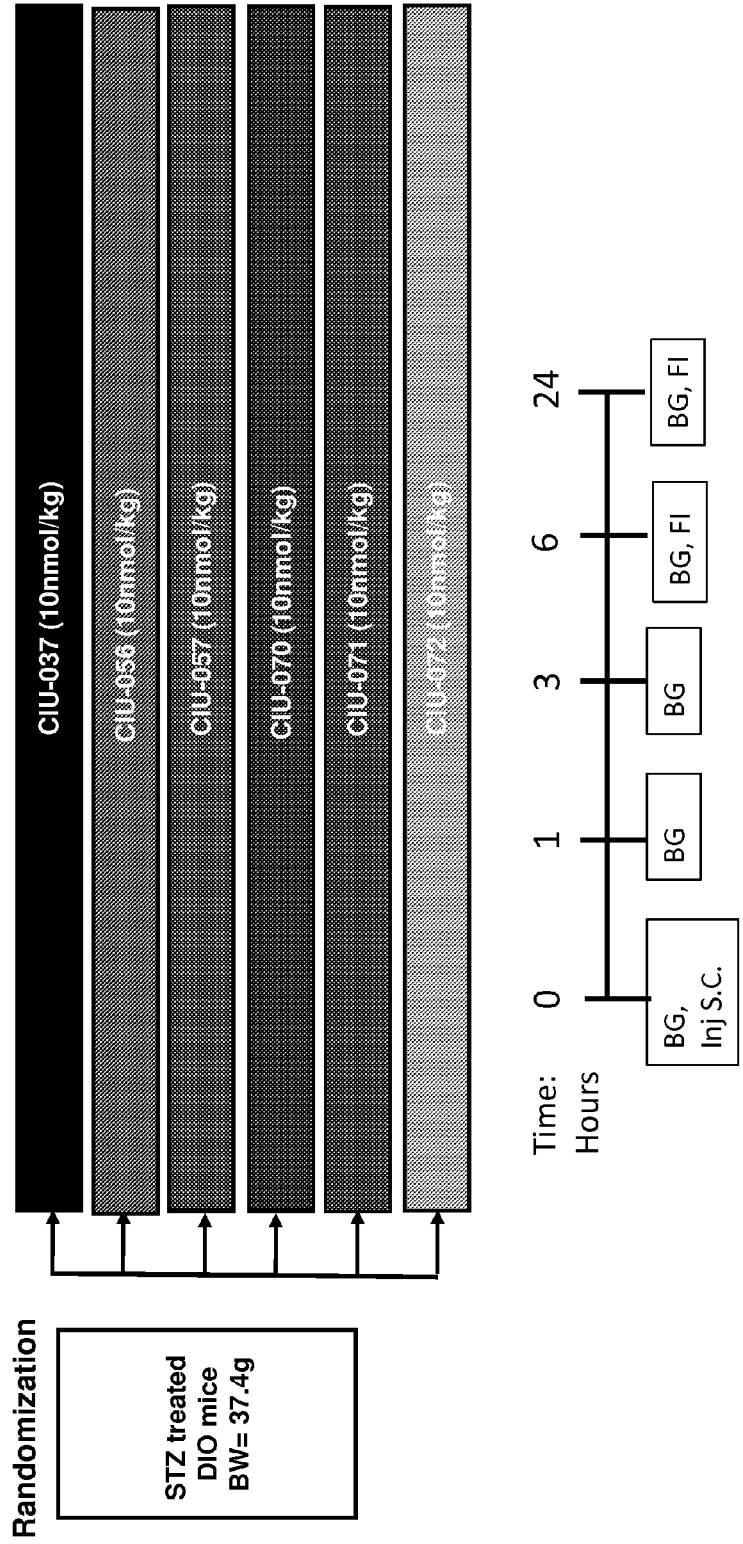
Fig. 18A  Exp. I-48: Comparative Glucose Lowering (Increlin Dimers)

x = Aib

INCRETIN-INSULIN CONJUGATES

CROSS REFERENCE TO RELATED APPLICATIONS

This application is a U.S. national counterpart application of international application Serial No. PCT/US2015/051728 filed Sep. 23, 2015, which claims priority to U.S. Provisional Application Ser. No. 62/054,666 filed Sep. 24, 2014, the disclosures of which are expressly incorporated by reference in their entirety.

INCORPORATION BY REFERENCE OF MATERIAL SUBMITTED ELECTRONICALLY

Incorporated by reference in its entirety is a computer-readable nucleotide/amino acid sequence listing submitted concurrently herewith and identified as follows: One 1052 KB ACII (Text) file named "263382_Seq List_ST25.txt" created on Jun. 12, 2018.

BACKGROUND

Insulin is a proven therapy for the treatment of juvenile-onset diabetes and later stage adult-onset diabetes. The peptide is biosynthesized as a larger linear precursor of low potency (approximately 2% to 9% of native insulin), named proinsulin. Proinsulin is proteolytically converted to insulin by the selective removal of a 35-residue connecting peptide (C peptide). The resultant heteroduplex formed by disulfide links between the insulin "A chain" (SEQ ID NO: 1) and "B chain" (SEQ ID NO: 2) chain, representing a total of 51 amino acids, has high potency for the insulin receptor (nM range). Native insulin has approximately one hundredfold selective affinity for the insulin receptor relative to the related insulin-like growth factor 1 receptor, but demonstrates little selectively for the two different insulin receptor isoforms, named A & B.

Incretins are a group of gastrointestinal hormones that that are involved in a wide variety of physiological functions, including glucose homeostasis, insulin secretion, gastric emptying, and intestinal growth, as well as the regulation of food intake. Pre-proglucagon is a 158 amino acid precursor polypeptide that is processed in different tissues to form a number of different peptides. Incretins include a number of proglucagon-derived peptides, including glucagon (SEQ ID NO: 701), glucagon-like peptide-1 (GLP-1; amino acids 7-37 are provided as SEQ ID NO: 703 and amino acids 7-36 as SEQ ID NO: 704), glucagon-like peptide-2 (GLP-2; SEQ ID NO: 708) and oxyntomodulin (OXM; SEQ ID NO: 706).

Glucagon is a 29-amino acid peptide that corresponds to amino acids 33 through 61 of pre-proglucagon, while GLP-1 is produced as a 37-amino acid peptide that corresponds to amino acids 72 through 108 of pre-proglucagon. GLP-1(7-36) amide (SEQ ID NO: 704; the C terminus is an arginine amide) or GLP-1(7-37) acid (SEQ ID NO: 703; C terminus is a glycine) are biologically potent forms of GLP-1, that demonstrate essentially equivalent activity at the GLP-1 receptor.

Glucagon is a life-saving medicine that is used in the acute treatment of severe hypoglycemia. Oxyntomodulin has been reported to have pharmacological ability to suppress appetite and lower body weight. Clinical studies with GLP-1 receptor agonists or stabilized GLP-1 analogs have proven this family of peptides to be an effective treatment for Type II diabetes.

In addition, gastric inhibitory polypeptide (GIP) is also known as a glucose-dependent insulinotropic peptide, and is a member of the secretin family of hormones. GIP is derived from a 153-amino acid proprotein encoded by the GIP gene and circulates as a biologically active 42-amino acid peptide (SEQ ID NO: 707). The GIP gene is expressed in the small intestine as well as the salivary glands and is a weak inhibitor of gastric acid secretion. In addition to its inhibitory effects in the stomach, in the presence of glucose, GIP enhances insulin release by pancreatic beta islet cells when administered in physiological doses. GIP is believed to function as an enteric factor that stimulates the release of pancreatic insulin and that may play a physiological role in maintaining glucose homeostasis.

As disclosed herein conjugates are formed between an insulin peptide and an incretin, including for example a glucagon, GLP-1, or GIP agonist, a GLP-1/GIP co-agonist, a GLP-1/glucagon co-agonist or a glucagon/GLP-1/GIP triagonist, wherein the conjugate has agonist activity at both the insulin receptor and the corresponding incretin receptor. More particularly, the conjugation of a glucagon related peptide (e.g., GIP, GLP-1 or glucagon) is anticipated to produce a beneficial modification of the insulin peptide activity. For example, linking a peptide having agonist activity at the glucagon receptor to an insulin peptide is anticipated to enhance targeting of the conjugate to the liver since the glucagon receptor is predominately located in the liver. Targeting of the conjugate to the liver is desirable since the liver is primarily involved in glucose production not utilization. Thus targeting the liver may be a safer approach to shutting off glucose production than occurs when insulin contacts other tissues such as muscle or fat, where in addition to turning off glucose production it also stimulates glucose use leading to a higher risk of hypoglycemia. Also, there are glucagon receptors present on the alpha cells of the pancreas. Delivering the complex to the alpha cells may suppress additional glucagon production or make the alpha cell more sensitive to hypoglycemia. Applicants also anticipate that the presence of glucagon in the glucagon-insulin conjugates may serve as a buffer on the activity of the coupled insulin to provide a more baseline activity and thus avoid spikes in blood glucose levels.

Similarly, it is anticipated that conjugates of insulin peptides with other glucagon related peptides including the incretins GLP-1 and GIP and other related peptides having activity at the GLP-1 and/or GIP receptors will produce conjugates having beneficial properties. For example, GLP-insulin conjugate may be targeted to the hypothalamus, to decrease appetite as well as reduce blood glucose. Alternatively or additionally, the GLP-insulin conjugate may be targeted to the beta cells to drive anabolic response (increase islet beta cells' production of insulin).

The incretin-insulin peptide conjugates are also suitable for further structural enhancements that are envisioned to yield improved therapeutic index, through the use of prodrug chemistry; extended duration of action, by linkage of plasma proteins such as albumin, or other modifications, including pegylation and lipidation (e.g., addition of C14-C30 alkyl or acyl groups); and enhanced physical stability, by glycosylation. The preparation of single chain insulin analogs using a C-peptide linker also provides a novel structural location for where many of these chemical modifications can be successfully deployed. One use of the insulin conjugates disclosed herein would be in the treatment of diabetes while stimulating weight loss or preventing weight gain.

SUMMARY

An insulin agonist/incretin conjugate is provided wherein the conjugate has agonist activity at both the insulin receptor and the corresponding incretin receptor. More particularly, in one embodiment an insulin agonist/incretin conjugate is provided wherein the conjugate has agonist activity at both the insulin receptor and at the GLP-1 and/or GIP receptor. In accordance with one embodiment a single compound is provide as a conjugate of an insulin protein and an incretin protein, wherein the conjugate acts as a full potency insulin agonist that induces weight loss or prevents weight gain. The insulin peptide component of the conjugate can be native insulin or any known insulin analog that has activity at the insulin receptor including for example any insulin peptide disclosed in published international applications WO96/34882, WO 2010/080607, WO 2010/080609, WO 2011/159882, WO/2011/159895 and U.S. Pat. No. 6,630,348, the disclosures of which are incorporated herein by reference. The incretin component of the conjugate can be any incretin peptide as disclosed herein including for example native glucagon, GLP-1, GIP or any known incretin or incretin peptide that has activity at one or more incretin receptors. Incretin peptides suitable for use in accordance with this disclosure include, for example, any incretin peptide disclosed in published international applications WO 2009/155258, WO 2009/058734, WO 2011/094337, WO 2009/148089, WO 2011/163473 and WO 2010/071807, the disclosures of which are expressly incorporated herein in their entirety.

In accordance with one embodiment an incretin peptide is linked to an insulin peptide via a linking moiety of the general structure of Formula I:

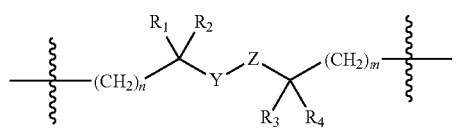

wherein $R_1$, $R_2$, $R_3$ and $R_4$ are independently selected from the group consisting of H, and $C_1$-$C_3$ alkyl;

Y is C, S, Se or S=O,

Z is C, S, Se, —S($C_1$-$C_3$)($C_5$-$C_6$ aryl)-, or Z in combination with Y is —C=C—, —O—N=, or a 1,2,3 triazole;

n is 0 or 1; and m is 1, 2 or 3, with the proviso that when Y is S=O, Z is C. In one embodiment the linking moiety is a disulfide linker of the general formula:

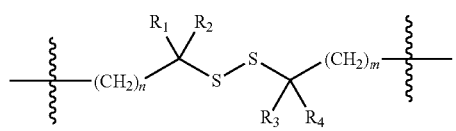

wherein $R_1$, $R_2$, $R_3$ and $R_4$ are independently selected from the group consisting of H, and $C_1$-$C_3$ alkyl, n is 0 or 1, and m is 1, 2 or 3. In one embodiment n is 0, m is 2, $R_4$ is H and $R_1$, $R_2$ and $R_3$ are independently selected from the group consisting of H, and methyl.

In accordance with one embodiment conjugates formed by linking an incretin peptide to an insulin peptide, via a linking moiety of Formula I or II, are provided that demonstrate high potency, balanced activity at the respective receptors of the conjugate, glucose lowering capability and enhanced fat mass loss when injected in normal and diabetic model mice. In one embodiment the C-terminal region of the incretin peptides is covalently linked, via a linking moiety of Formula I or II, to the insulin peptide through a position independently selected from the side chain of an amino acid at a position selected from A9, A14 or A15 of the A chain, positions B1, B2, B3, B10, B22, B28 or B29 of the B chain, the N-terminal alpha amine of the B chain, the carboxy terminus of the A or B chain and at the side chain of an amino acid at any position of a linking moiety that links the A chain and B chain of a single chain insulin analog. In accordance with one embodiment the carboxy terminus of a incretin peptide is linked to the N-terminus of an insulin peptide via the disulfide linking moiety of Formula II, optionally wherein the carboxy terminus of a incretin peptide is linked to the N-terminus of the B chain of a two chain insulin peptide via the disulfide linking moiety of Formula II.

As used herein reference to the C-terminal region of the incretin peptide is intended to encompass the native C-terminus of a glucagon, GLP-1 or GIP peptide, or any amino acid added to the native C-terminus of a glucagon, GLP-1 or GIP analog, or the C-terminal amino acid of a glucagon analog that has been shortened by the deletion amino acids at the C-terminus, respectively, relative to the native glucagon sequence. For example the C-terminus of the native incretin peptide can be extended by 1 to 3 amino acids which are then linked to the insulin peptide either through the side chain of an amino acid of the C-terminal region or through the C-terminal carboxy group. In one embodiment the carboxy terminal region of the incretin peptide is covalently linked to the amino terminal region of the B chain of the insulin peptide.

In one embodiment the insulin peptide of the conjugate is a two chain insulin analog comprising an A chain and B chain linked to one another via disulfide bonds. In a further embodiment the conjugate comprises a two chain insulin analog wherein a incretin peptide is covalently linked to the insulin peptide at a position selected from the group consisting of the amino terminus of the B chain, the carboxy terminal region of the A chain, and the carboxy terminal region of the B chain. In one embodiment the incretin peptide is linked to the insulin peptide via a disulfide binding moiety of the general structure:

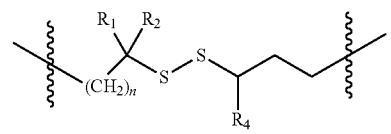

wherein $R_1$, $R_2$ and $R_4$ are independently selected from the group consisting of H, and $CH_3$; and n is 0 or 1.

In one embodiment the incretin peptide is selected from the group consisting of native glucagon, native GLP-1 and native GIP. In one embodiment the incretin peptide is a glucagon analog having activity at two or more incretin receptors selected from the glucagon receptor, the GLP-1 receptor or the GIP receptor. In one embodiment the incretin peptide component of the conjugate comprises (i) the amino acid sequence:

X₁-X₂-Gln-Gly-Thr-Phe-Thr-Ser-Asp-Tyr-Ser-Lys-Tyr-Leu-Asp-Ser-Arg-Arg-Ala-Gln-Asp-Phe-Val-Gln-Trp-Leu-Met-Z (SEQ ID NO: 839) with 1 to 3 amino acid modifications thereto, wherein $X_1$ and/or $X_2$ is a non-native (relative to SEQ ID NO: 701) amino acid that reduces susceptibility of the incretin peptide to cleavage by dipeptidyl peptidase IV (DPP-IV), Z is selected from the group consisting of —COOH, -Asn-COOH, Asn-Thr-COOH, GPSSGAPPPS (SEQ ID NO: 78) and Y—COOH, wherein Y is 1 to 2 amino acids, and further wherein (1) a lactam bridge connects the side chains of an amino acid at position i and an amino acid at position i+4, wherein i is 12, 16, 20 or 24 or (2) one, two, three, or all of the amino acids at positions 16, 20, 21, and 24 of the incretin peptide is substituted with an α,α-disubstituted amino acid;

and said incretin peptide has glucagon agonist activity;

(ii) the amino acid sequence of SEQ ID NO: 701 modified to comprise at least one amino acid modification selected from the group consisting of:

substitution of Asn at position 28 with a charged amino acid;

substitution of Asn at position 28 with a charged amino acid selected from the group consisting of Lys, Arg, His, Asp, Glu, cysteic acid, and homocysteic acid;

substitution at position 28 with Asn, Asp, or Glu;

substitution at position 28 with Asp;

substitution at position 28 with Glu;

substitution of Thr at position 29 with a charged amino acid;

substitution of Thr at position 29 with a charged amino acid selected from the group consisting of Lys, Arg, His, Asp, Glu, cysteic acid, and homocysteic acid;

substitution at position 29 with Asp, Glu, or Lys;

substitution at position 29 with Glu;

insertion of 1-3 charged amino acids after position 29;

insertion after position 29 of Glu or Lys;

insertion after position 29 of Gly-Lys or Lys-Lys; or a combination thereof;

and at least one amino acid modification selected from Group A or Group B, or a combination thereof;

wherein Group A is an amino acid modification selected from the group consisting of substitution of Asp at position 15 with Glu, and substitution of Ser at position 16 with Thr or AIB; and wherein Group B is an amino acid modification selected from the group consisting of:

substitution of His at position 1 with a non-native amino acid that reduces susceptibility of the incretin peptide to cleavage by dipeptidyl peptidase IV (DPP-IV), substitution of Ser at position 2 with a non-native amino acid that reduces susceptibility of the incretin peptide to cleavage by dipeptidyl peptidase IV (DPP-IV), substitution of Tyr at position 10 with Phe or Val;

substitution of Lys at position 12 with Arg;

substitution of Gln at position 20 with Ala or AIB;

substitution of Asp at position 21 with Glu;

substitution of Gln at position 24 with Ala or AIB;

substitution of Met at position 27 with Leu or Nle;

deletion of amino acids at positions 27-29;

deletion of amino acids at positions 28-29;

deletion of the amino acid at positions 29;

or a combination thereof;

and wherein said incretin peptide has glucagon agonist activity;

(iii) a incretin peptide of SEQ ID NO: 701, modified to comprise (a) an amino acid modification at position 1 that confers GIP agonist activity, (b) (1) a lactam bridge between the side chains of amino acids at positions i and i+4 or between the side chains of amino acids at positions j and j+3, wherein i is 12, 13, 16, 17, 20 or 24, and wherein j is 17, or (2) one, two, three, or all of the amino acids at positions 16, 20, 21, and 24 of the analog is substituted with an α,α-disubstituted amino acid, (c) amino acid modifications at one, two or all of positions 27, 28 and 29, and (d) 1-6 further amino acid modifications, wherein the EC50 of the analog for GIP receptor activation is about 10 nM or less;

(iv) the sequence of $X_1X_2X_3GTFTSDX_{10}SX_{12}YLX_{15}X_{16}X_{17}X_{18}AX_{20}X_{21}FX_{23}X_{24}WLX_{27}X_{28}X_{29}$ (SEQ ID NO: 1926) wherein $X_1$ is selected from the group consisting of His, D-His, (Des-amino)His, hydroxyl-His, acetyl-His, homo-His or alpha, alpha-dimethyl imidiazole acetic acid (DMIA), N-methyl His, alpha-methyl His, and imidazole acetic acid;

$X_2$ is selected from the group consisting of Ser, D-Ser, Ala, D-Ala, Val, Gly, N-methyl Ser, aminoisobutyric acid (Aib) and N-methyl Ala;

$X_3$ is selected from the group consisting of Gln, Glu, Orn and Nle;

$X_{10}$ is selected from the group consisting of Tyr, Val and Trp;

$X_{12}$ is selected from the group consisting of Ser, Lys and Arg;

$X_{15}$ is selected from the group consisting of Asp, Glu, cysteic acid, homoglutamic acid and homocysteic acid;

$X_{16}$ is selected from the group consisting of Ser, Gly, Glu, Gln, homoglutamic acid and homocysteic acid;

$X_{17}$ is selected from the group consisting of Arg, Gln, Lys, Cys, Orn, homocysteine and acetyl phenylalanine;

$X_{18}$ is selected from the group consisting of Arg, Ala, Lys, Cys, Orn, homocysteine and acetyl phenylalanine;

$X_{20}$ is selected from the group consisting of Gln, Lys, Arg, Orn and Citrulline;

$X_{21}$ is selected from the group consisting of Gln, Glu, Asp, Lys, Cys, Orn, homocysteine and acetyl phenylalanine;

$X_{23}$ is selected from the group consisting of Val and Ile;

$X_{24}$ is selected from the group consisting of Ala, Gln, Glu, Lys, Cys, Orn, homocysteine and acetyl phenylalanine;

$X_{27}$ is selected from the group consisting of Met, Val, Leu and Nle;

$X_{28}$ is selected from the group consisting of Asn, Lys and Asp; and $X_{29}$ is selected from the group consisting of Thr, Gly, Lys, Cys, Orn, homocysteine and acetyl phenylalanine; or an analog of SEQ ID NO: 1926, wherein said analog differs from SEQ ID NO: 1926 by 1, 2 or 3 amino acid modifications, selected from positions 1, 2, 3, 5, 7, 10, 11, 13, 14, 17, 18, 19, 21, 24, 27, 28, and 29, wherein said incretin peptide exhibits at least 20% of the activity of native GLP-1 at the GLP-1 receptor;

(v) an amino acid that differs from SEQ ID NO: 701 by no more than ten amino acid modifications, comprising one or more amino acid substitutions with AIB at positions 16, 20, 21, and/or 24, and an amino acid modification at position 1 and/or 2 that provides reduced susceptibility to cleavage by dipeptidyl peptidase IV, wherein said incretin peptide exhibits at least 20% of the activity of native GLP-1 at the GLP-1 receptor. In one embodiment the incretin peptide comprises a peptide of any of (ii) through (v) wherein the peptide is further modified to comprise a C-terminal extension of GPSSGAPPPS (SEQ ID NO: 820).

In accordance with one embodiment the incretin component of the conjugate comprises the sequence $X_1X_2X_3GTFX_7SDX_{10}SX_{12}YLX_{15}X_{16}X_{17}AAX_{20}X_{21}FVX_{24}WLLX_{28}X_{29}$ (SEQ ID NO: 2039), wherein $X_1$ is Tyr or His;
$X_2$ is Ser, D-serine, Ala, Val, glycine, N-methyl serine, aminoisobutyric acid (Aib),
N-methyl alanine or D-alanine, optionally $X_2$ is Aib;
$X_3$ is Glu or Gln;
$X_7$ is Thr or Ile;
$X_{10}$ is Lys, Tyr or Val;
$X_{12}$ is Ser, Lys, Arg or Ile;
$X_{15}$ is Glu or Asp;
$X_{16}$ is Glu or Lys;
$X_{17}$ is Gln or Arg;
$X_{20}$ is Gln or Aib;
$X_{21}$ is Glu or Asp;
$X_{24}$ is Asn, Gln or Ala;
$X_{28}$ is Ala, Glu, or Asp; and
$X_{29}$ is Ala or Gly.

In one embodiment the incretin component of the conjugate comprises a sequence selected from the group consisting of SEQ ID NO: 132, SEQ ID NO: 135, SEQ ID NO: 139 and SEQ ID NO: 140 or an analog thereof that differs from SEQ ID NO: 132, SEQ ID NO: 135, SEQ ID NO: 139 or SEQ ID NO: 140 by 1, 2, 3, 4 or 5 amino acid modifications. In one embodiment the incretin component of the conjugate comprises a sequence that differs from SEQ ID NO: 132, SEQ ID NO: 135, SEQ ID NO: 139 or SEQ ID NO: 140 by 1, 2 or 3 amino acid substitutions. In one embodiment the incretin component of the conjugate comprises a sequence selected from the group consisting of SEQ ID NO 1991-1995, 2000, 2001, 2007, 2008-2021 and 2024-2028. In one embodiment the incretin component of the conjugate comprises a sequence selected from the group consisting of SEQ ID NO: 2019, SEQ ID NO: 2021, SEQ ID NO: 2027 and SEQ ID NO: 2028 or an analog thereof that differs from SEQ ID NO: 2019, SEQ ID NO: 2021, SEQ ID NO: 2027 or SEQ ID NO: 2028 by 1, 2, 3, 4 or 5 amino acid modifications. In one embodiment the incretin component of the conjugate comprises a sequence selected from the group consisting of SEQ ID NO: 2019, 2021 and 2024-2028 or a sequence that differs from SEQ ID NO: 2019, 2021 or SEQ ID NO: 2024-2028 by 1, 2 or 3 amino acid substitutions. In one embodiment the incretin component of the conjugate comprises a sequence selected from the group consisting of SEQ ID NO: 2019 or 2021 or a sequence that differs from SEQ ID NO: 2019, 2021 or SEQ ID NO: 2024-2028 by 1, 2 or 3 amino acid modifications. In one embodiment the incretin component of the conjugate comprises or consists of a sequence selected from the group consisting of SEQ ID NO: 2019 or 2021. In one embodiment the incretin component of the conjugate comprises or consists of the sequence of SEQ ID NO: 2019. In one embodiment the incretin peptide comprises the sequence of SEQ ID NO: 2037 or 2038.

In one embodiment the insulin peptide of the conjugate comprises an A chain and a B chain wherein said A chain comprises a sequence $GIVX_4X_5CCX_8X_9X_{10}CX_{12}LX_{14}X_{15}LX_{17}X_{18}YCX_{21}$—$R_{13}$ (SEQ ID NO: 19), and said B chain comprises a sequence $R_{22}$—$X_{25}LCGX_{29}X_{30}LVX_{33}X_{34}LYLVCGX_{41}X_{42}GFX_{45}$ (SEQ ID NO: 20), wherein $X_4$ is glutamic acid or aspartic acid;
$X_5$ is glutamine or glutamic acid
$X_8$ is histidine, threonine or phenylalanine;
$X_9$ is serine, arginine, lysine, ornithine or alanine;
$X_{10}$ is isoleucine or serine;
$X_{12}$ is serine or aspartic acid;
$X_{14}$ is tyrosine, arginine, lysine, ornithine or alanine;
$X_{15}$ is glutamine, glutamic acid, arginine, alanine, lysine, ornithine or leucine;
$X_{17}$ is glutamic acid, aspartic acid, asparagine, lysine, ornithine or glutamine;
$X_{18}$ is methionine, asparagine, glutamine, aspartic acid, glutamic acid or threonine;
$X_{21}$ is selected from the group consisting of alanine, glycine, serine, valine, threonine, isoleucine, leucine, glutamine, glutamic acid, asparagine, aspartic acid, histidine, tryptophan, tyrosine, and methionine;
$X_{25}$ is histidine or threonine;
$X_{29}$ is selected from the group consisting of alanine, glycine and serine;
$X_{30}$ is selected from the group consisting of histidine, aspartic acid, glutamic acid, homocysteic acid and cysteic acid;
$X_{33}$ is selected from the group consisting of aspartic acid and glutamic acid;
$X_{34}$ is selected from the group consisting of alanine and threonine;
$X_{41}$ is selected from the group consisting of glutamic acid, aspartic acid or asparagine;
$X_{42}$ is selected from the group consisting of alanine, ornithine, lysine and arginine;
$X_{45}$ is tyrosine or phenylalanine;
$R_{22}$ is selected from the group consisting of AYRPSE (SEQ ID NO: 14), FVNQ (SEQ ID NO: 12), FVKQ (SEQ ID NO: 8), PGPE (SEQ ID NO: 11), a tripeptide glycine-proline-glutamic acid, a tripeptide valine-asparagine-glutamine, a dipeptide proline-glutamic acid, a dipeptide asparagine-glutamine, glutamine, glutamic acid and an N-terminal amine; and
$R_{13}$ is COOH or $CONH_2$.

In one embodiment the insulin peptide of the conjugate comprises an A chain and a B chain wherein said A chain comprises a sequence of SEQ ID NO: 1, or an amino acid sequence that differs from SEQ ID NO: 1 by one, two or three amino acid substitutions, and the B chain comprises a sequence selected from the group consisting of FVNQHLCGSHLVEALYLVCGERGFFYTPKT (SEQ ID NO: 2) FVNQHLCGSHLVEALYLVCGERGFFYTKPT (SEQ ID NO: 9) FVNQHLCGSHLVEALYLVCGERGFFYTDKT (SEQ ID NO: 5) FVKQHLCGSHLVEALYLVCGERGFFYTEKT (SEQ ID NO: 6), or an amino acid sequence that differs from SEQ ID NO: 2, 5, 6, or 9 by one, two or three amino acid substitutions.

In one embodiment the conjugate comprises the incretin peptide of SEQ ID NO: 2019, 2021, SEQ ID NO: 2024-2028, 2037 or 2038 linked via its carboxy terminus to the amino terminus of an insulin peptide comprising an A chain of SEQ ID NO: 1 and a B chain of SEQ ID NO: 2, 5, 6, or 9 via a linker comprising the general structure of Formula IV:

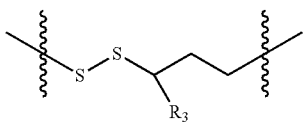

wherein R₃ is H or CH₃.

In one embodiment the incretin-insulin conjugate comprises a hydrophilic moiety linked to the N-terminal alpha amine of the B chain or to the side chain of an amino acid at a position selected from the group consisting of A9, A14 and A15 of the A chain or positions B1, B2, B10, B24, B28 or B29 of the B chain or to a side chain of an amino acid of the linking moiety in a single chain insulin analog. Alternatively, or in addition, a hydrophilic moiety can be linked to the incretin peptide at any of amino acid positions 16, 20, 23, 24, 27, 30, 32, 43 or the C-terminal region. In one embodiment the side chain of one or two amino acids at positions selected from positions 24, 30 or 40 of the incretin peptide, or positions B24, B28 or B29 of the insulin peptide are linked to a hydrophilic moiety.

In one embodiment the hydrophilic moiety is a polyethylene chain and in a further embodiment the polyethylene chain is covalently bound to the side chain of an amino acid of the linking moiety of the insulin peptide component, when the insulin peptide is a single chain insulin analog. In one embodiment the hydrophilic moiety is an Fc peptide or other immunoglobulin peptide fragment. In one embodiment the insulin peptide is a single chain insulin wherein linking moiety joining the B and A chains comprises an amino acid sequence of no more than 17 amino acids in length and comprising the sequence GYGSSSRR (SEQ ID NO: 61), GAGSSSRR (SEQ ID NO: 1925) or GYGSSSRRAPQT; (SEQ ID NO: 23) In one embodiment the peptide linker joining the B and A chains is selected from the group consisting of SSSSKAPPPSLPSPSRLPGPSDTPILPQR (SEQ ID NO: 1922), SSSSRAPPPSLPSPSRLPGPSDTPIL-PQK (SEQ ID NO: 1923).

Acylation or alkylation can increase the half-life of the incretin-insulin conjugate peptides in circulation. Acylation or alkylation can advantageously delay the onset of action and/or extend the duration of action at the insulin receptors. The incretin-insulin conjugate peptides may be acylated or alkylated at the same amino acid position where a hydrophilic moiety is linked (including, for example at position 8 of the linking moiety joining a single chain insulin analog), or at a different amino acid position. In accordance with one embodiment the conjugates of the present invention are acylated at position 10, 16, 20, 30 and 40 of the incretin peptide or at position B28 or B29 of the insulin peptide. In one embodiment the conjugates of the present invention are acylated at position 10 or 40 of the incretin peptide or at position B29 of the insulin peptide, wherein the acylating moiety is of sufficient size to bind albumin in serum.

Also encompassed by the present disclosure are pharmaceutical compositions comprising the incretin-insulin conjugates and a pharmaceutically acceptable carrier. In accordance with one embodiment a pharmaceutical composition is provided comprising any of the incretin-insulin conjugates disclosed herein preferably at a purity level of at least 90%, 91%, 92%, 93%, 94%, 95%, 96%, 97%, 98% or 99%, and a pharmaceutically acceptable diluent, carrier or excipient. Such compositions may contain a single chain insulin agonist peptide as disclosed herein at a concentration of at least 0.5 mg/ml, 1 mg/ml, 2 mg/ml, 3 mg/ml, 4 mg/ml, 5 mg/ml, 6 mg/ml, 7 mg/ml, 8 mg/ml, 9 mg/ml, 10 mg/ml, 11 mg/ml, 12 mg/ml, 13 mg/ml, 14 mg/ml, 15 mg/ml, 16 mg/ml, 17 mg/ml, 18 mg/ml, 19 mg/ml, 20 mg/ml, 21 mg/ml, 22 mg/ml, 23 mg/ml, 24 mg/ml, 25 mg/ml or higher. In one embodiment the pharmaceutical compositions comprise aqueous solutions that are sterilized and optionally stored within various package containers. In other embodiments the pharmaceutical compositions comprise a lyophilized powder. The pharmaceutical compositions can be further packaged as part of a kit that includes a disposable device for administering the composition to a patient. The containers or kits may be labeled for storage at ambient room temperature or at refrigerated temperature.

In accordance with one embodiment an improved method of regulating blood glucose levels in insulin dependent patients while increasing weight loss or preventing weight gain is provided. The method comprises the steps of administering to a patient an incretin-insulin conjugate, wherein the carboxy terminus of the incretin is linked to the amino terminus of the insulin peptide by a spacer having the general structure of Formula I, II, III or IV, in an amount therapeutically effective for the control of diabetes.

BRIEF DESCRIPTION OF THE DRAWINGS

FIG. 2 provides the general structure of linkers suitable for use in joining an incretin to an insulin peptide to form a conjugate in accordance with the present disclosure. Each of the disclosed structures is suitable for use in coupling any incretin disclosed herein to any insulin as disclosed herein. As designated in FIG. 2, the [0.0] structure is also known as "the cysteine disulfide linkage" and the designated [2.0] structure is also known as "the penicillamine disulfide linkage".

FIG. 3 provides additional linkers that can be used to prepare the generic structures of incretin-insulin conjugates.

FIGS. 4A-4D provides a synthetic scheme for synthesizing incretin and insulin fusion peptides.

FIG. 5B) at the insulin subtype B receptor. The fusion peptides differ based on the spacer joining the incretin and the insulin and are prepared using a disulfide linker, including cysteine (●), homocysteine (▲), penicillamine (▼), and desHis with a cystesine linker (◄). Insulin (■) is included as well as IGF-1 (►). DesHIUB48C is an incretin modified by the removal of the N-terminal histidine amino acid eliminating incretin activity. All incretin-insulin fusions were found to have high potency at the insulin receptor, similar to that of native insulin. Therefore, the linker provides full potency regardless of fusing a GLP peptide (FIG. 5A) or a glucagon peptide (FIG. 5B).

FIGS. 6A & 6B are graphs demonstrating the in vitro activity of a GLP-1/insulin fusion peptide (IUB48, FIG. 6A) and a glucagon/insulin fusion peptide (IUB496, FIG. 6B) at the respective GLP-1 receptor and the glucagon receptor, wherein the GLP-1 sequence is HXEGTFTSDVSSYLE-EQAAKEFIAWLVKGGPSSGAPPPS (SEQ ID NO: 1932) and the glucagon sequence is HSQTFTSDYSKYLDSR-RAQDFVQWLMNTGPSSGAPPPS (SEQ ID NO: 521) and the insulin peptide is native insulin. The fusion peptides differ based on the spacer joining the incretin and the insulin and are prepared using a disulfide linker, including cysteine (●), homocysteine (▲), and penicillamine (▼) and desHis with a cysteine linker (◄). Glucagon (■) is included as well as IGF-1(►). DesHiUB48C-insulin is an incretin modified by the removal of the N-terminal histidine amino acid, thus eliminating incretin activity. All incretin-insulin fusions were found to have high potency at the GLP-1 and glucagon receptors, with the exception of DesHiUB48C-insulin which due to the deletion of the N-terminal histidine residue would not be expected to have activity at the GLP-1 and glucagon receptors. The GLP-1-insulin conjugates also show little activity at the glucagon receptor due to the fact that GLP-1 has very little activity at the glucagon receptor. Therefore, the incretin-insulin conjugates demonstrate full potency for the GLP-1 or glucagon agonist component of the incretin-insulin conjugate at their respective receptors.

FIG. 7 demonstrates the relative stability of the incretin-insulin conjugate in plasma. Incretin-insulin conjugates formed using a cysteine or a penicillamine linker were incubated for 72 hours in plasma, no significant degradation occurs and no differences were detected between the two linkers used.

FIG. 8 is a graph demonstrating the results of administering a 50 nmoles/kg dose of an incretin-insulin conjugate to normal mice. IUB-48 is a GLP-1 agonist that will lower blood glucose levels to about 60 mg/dL. When IUB-48 is linked to native insulin via cysteine (♦), penicillamine (●) or homocysteine (■), the conjugates all drop blood glucose levels to levels below that achieved with IUB-48 as the sole active agent.

FIG. 9A provides a schematic representation of the experimental procedure. CIU-001 is a GLP-1/insulin conjugate (wherein the GLP-1 peptide consists of the sequence of SEQ ID NO: 1932 and the insulin peptide is native insulin), CIU-004 is CIU-001 modified to remove the N-terminal histidine (SEQ ID NO: 1081) destroying incretin receptor binding activity) and CIU-014 is CIU-001 wherein the C-terminus of the B chain is linked directly to the N-terminus of the A chain via a minipeg (destroying insulin activity). FIG. 9B is a graph presenting the results, wherein CIU-004 and CIU-001 (having insulin activity) are fully potent in reducing blood glucose to below 50 mg/dL, wherein the compound lacking insulin activity can only reduce blood glucose to about 60 mg/dL activity, consistent with GLP-1 activity. Thus the conjugates retain the activity of both peptides even when fused together in accordance with this disclosure.

FIGS. 10A-10D: FIG. 10A provides the locations where the incretin-insulin conjugates [comprising an incretin of: HXEGTFTSDVSSYLEEQAAREFIAWLVRGGPSSGAP-PPSXC (SEQ ID NO: 2029); HXEGTFTSDXSSYLE-EQAAREFIAWLVRGGPSSGAPPPSC SEQ ID NO: 2030); HXEGTFTSDVSSYLEEQAAREFIAWLVRGGPSSGAP-PPSC (SEQ ID NO 2031); and HXEGTFTSDXSSYLE-EQAAREFIAWLVRGGPSSGAPPPSXC (SEQ ID NO: 2032) linked to native insulin (having an A chain of SEQ ID NO: 1 and a B chain of SEQ ID NO: 2) via a disulfide linker (—(S—S)—CH$_2$ CH$_2$ CH$_2$—) wherein the linker extends from the C-terminal cysteine added to the incretin and is covalently bound to the N-terminal amine of the insulin B chain] can be further modified to link an acyl or alkyl group or a polyethylene chain to extend the duration of action of the underlying incretin-insulin conjugate. FIGS. 10B and 10C provide synthetic schemes for preparing the acyl or pegylated incretin-insulin conjugates, respectively. FIG. 10D provides the activity of the acylated incretin-insulin conjugates at the GLP-1, GIP and insulin receptors wherein a native two chain insulin is linked to an incretin selected from the group consisting of HXEGTFTSDVSSYLE-EQAAKEFIAWLVKGGPSSGAPPPSC (SEQ ID NO 2033); HXEGTFTSDK(rEC16)SSYLEEQAAKEFI-AWLVKGGPSSGAPPPSGC (SEQ ID NO: 2034) and HXEGTFTSDVSSYLEEQAAKEFIAWLVKGGPSSGAP-PPSGK(rEC16)C (SEQ ID NO: 2035)

FIGS. 11A-11B provide the results of an experiment conducted on diabetic mice administered a 5, 15 or 20 nmoles/kg dose of an incretin-insulin conjugate (HXEGT-FTSDVSSYLEEQAAKEFIAWLVKGGPSSGAPPPSUC (SEQ ID NO: 1927)-(S—S)—CH$_2$CH$_2$CH$_2$—B1 insulin (CIU-013)), wherein the incretin moiety has been acylated at the lysine amino acid side chain at position 40. In particular, the "U" of SEQ ID NO: 1927 represents a lysine acylated with a C16 acyl group via a gamma glutamic acid linker (Lys(γ-Glu-C16)). FIG. 11A provides a schematic representation of the experimental procedure. FIG. 11B is a graph presenting the results, wherein all doses of the compound are effective in lowering blood glucose.

FIGS. 12A & 12B provide the results of an experiment administering a second dose of the incretin-insulin conjugate (HXEGTFTSDVSSYLEEQAAKEFIAWLVKGGPSSGAP-PPSUC (SEQ ID NO: 1927)-(S—S)—CH$_2$CH$_2$CH$_2$—B1Insulin (CIU-013)), to diabetic mice fed 6 hours after administration of the first dose. FIG. 12A provides a schematic representation of the experimental procedure. FIG. 12B is a graph presenting the results wherein a second administration of the conjugate at 6 hours (CIU-13 10 nmole/kg(×2)) helps lower the 24 hour blood glucose and keep it at about 100 mg/dL, whereas mice not administered a second dose continue to experience increased blood glucose levels.

FIG. 13 is a bar graph demonstrating that the incretin-insulin conjugate (HXEGTFTSDVSSYLEEQAAKEFI-AWLVKGGPSSGAPPPSUC (SEQ ID NO: 1927)-(S—S)—CH$_2$CH$_2$CH$_2$—B1Insulin (CIU-013)), is suppressing food intake wherein pegylated insulin does not. Accordingly the GLP-1 based incretin-insulin conjugates have activity in lowering blood glucose levels as well as reduce food intake since they have the activity of both GLP-1 and insulin.

FIGS. 14A-14D provide the results of an experiment conducted on diabetic mice administered a pegylated native insulin or the incretin-insulin conjugate (HXEGTFTSDVS-SYLEEQAAKEFIAWLVKGGPSSGAPPPSUC (SEQ ID NO: 1927)-(S—S)—CH$_2$CH$_2$CH$_2$—B1Insulin (CIU-013)), over the course of four days. The acylated CIU-13 conjugate was administered either daily or twice a day. FIG. 14A provides a schematic representation of the experimental procedure. FIG. 14B is a graph presenting the results, wherein the pegylated insulin failed to induce weight loss when administered either daily or twice a day, but the acylated CIU-13 conjugate produced significant weight loss. FIG. 14C is a graph demonstrating that the acylated CIU-13 conjugate suppresses food intake relative to the administration of the pegylated insulin analog. FIG. 14D is a graph displaying the blood glucose of the mice after administration of the acylated CIU-13 conjugate (daily or 2× a day) or administration of the pegylated insulin analog (daily or 2× a day). The acylated CIU-13 conjugate is administered at one fifth the dosage of the pegylated insulin yet would appear to not be as effective as insulin.

FIGS. 15A-15C provide the results of an experiment conducted on diabetic mice administered four different acylated GLP-1/insulin conjugates. Two of the compounds are acylated at position 10 (CIU-12 (SEQ ID NO: 1953 and CIU-21 (SEQ ID NO: 1958) and two of the compounds are acylated at position 40 (CIU-13, SEQ ID NO: 1954; and CIU-22, SEQ ID NO: 1959). The spacer linking the incretin to the insulin is also different between the compounds with a cysteine disulfide linkage for CIU-12 and CIU-13 and a penicillamine disulfide linkage for CIU-21 and CIU-22. FIG. 15A provides a schematic representation of the experimental procedure. FIG. 15B is a graph presenting the results, wherein all compounds demonstrate activity in reducing blood glucose levels and demonstrate an extended duration of action relative to native insulin. FIG. 15C is a bar graph presenting the area under the curve. The results indicate a greater duration of action achieved with acylation at position 10 relative to acylation at position 40. No significant difference is seen between the cysteine disulfide linkage relative to the penicillamine disulfide linkage.

FIG. 16A-16C provide the results of an experiment conducted on diabetic mice administered three different doses (5, 10 or 20 nmol/kg) of a pegylated GLP-1/insulin conjugate (CIU-037). CIU-037 (SEQ ID NO: 1966) is pegylated with a 20K PEG at position 40 of the GLP-1 moiety. CUI-023 (SEQ ID NO: 1960) is pegylated with a 20K PEG at B29 of the insulin component. Animals were also administered 20 nmol/kg of a pegylated native insulin (20 K PEG linked to the B29 side chain). FIG. 16A provides a schematic representation of the experimental procedure. FIG. 16B is a graph presenting the results of the dose titration, with blood glucose levels inversely proportional to the dose administered. The pegylated GLP-1/insulin conjugates drop blood glucose levels more quickly and have a longer duration of action than the pegylated insulin (CIU-26). FIG. 16C is a bar graph indicating that the GLP-1 containing pegylated conjugates suppress food intake whereas the pegylated insulin analog did not.

FIG. 17A provides a schematic representation of the experimental procedure where animals were monitored over the course of seven days. FIG. 17B is a graph presenting the results of the dose titration, with improved blood glucose levels achieved relative to pegylated insulin and using less than 5% the dose. FIG. 17C is a graph demonstrating the ability of CIU-037 to suppress food intake, whereas CIU-26, the pegylated insulin does not. FIG. 17D is a graph presenting data demonstrating CIU-037, but not CIU-26, induces loss in body weight. FIG. 17E is a series of bar graphs indicating that the weight loss induced by CIU-037 comes from fat mass and not lean mass.

FIGS. 18A-18C provide the results of an experiment conducted on diabetic mice administered three different homodimers of GLP-1/insulin conjugates (CIU-070, SEQ ID NO: 1980; CIU-071, SEQ ID NO: 1981; and CIU-072, SEQ ID NO: 1982) relative to GLP-1/insulin conjugate monomers (CIU-037, SEQ ID NO: 1966; CIU-056, SEQ ID NO: 1975; CIU-057, SEQ ID NO: 1976). The CIU-072 conjugates are linked to form a dimer by a disulfide through a thiol that is added to the side-chain of the Lys40 in the GLP-agonist. The thiol is derived from cystamine (des-amino, Cys) that forms an amide bond through its carboxyl group to the amine of lysine. The CIU-070 and CIU-071 conjugates are linked to form a dimer by a bifunctional peg polymer at both ends. There is an amide bond formed between the side-chain lysine and the peg-polymer through N-hydroxysuccinimide mediated amide bond formation. The CIU-056 and CIU-057 peptides are monomers that are doubly pegylated with two 20 kd Pegs at the same positions K24 & K40 of the GLP-1 sequence. CIU-037 is pegylated with a 20K PEG at position 40 of the GLP-1 moiety. FIG. 18A provides a schematic representation of the experimental procedure. FIG. 18B is a graph presenting the results of the relative glucose lowering of each dimer. FIG. 18C is a graph presenting the results of the relative glucose lowering of each dimer as presented based on change in initial blood glucose to blood glucose levels after administration.

FIG. 19A provides a schematic representation of the experimental procedure wherein CIU-035 and CIU-036 are administered at two different doses 10 and 50 nmol/kg. FIG. 19B is a graph presenting the results of the relative glucose lowering of each prodrug relative to native insulin. The insulin prodrugs administered at 50 nmol/kg demonstrate rapid blood glucose lowering and have an extended duration of action relative to insulin. FIG. 19C is a graph presenting the first six hours after administering the prodrugs. This graph more clearly represents the extended duration of action of the prodrug form of the lipidated insulin prodrug relative to insulin.

DETAILED DESCRIPTION

Definitions

Figure 1A:
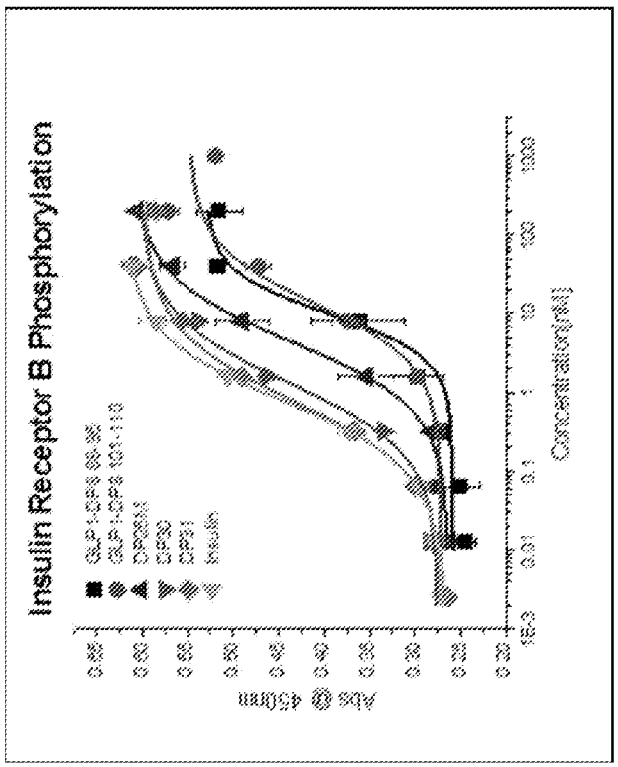
FIGS. 1A & 1B are graphs demonstrating the activity of a GLP-1/insulin fusion (GLP-DP8 (HAEGTFTSDVS-SYLEEQAAREFIAWLVRGRG-GPEHLCGAHLVDA-LYLVCGDRGFYFNDRGAGSSSRRGIVDECCHRSCDL-RRLENYCN; SEQ ID NO: 700); ■, comprising a GLP-1 agonist peptide fused the N-terminus of a single chain insulin analog relative to non-conjugated insulin analogs: DP25MGPEHLCGAHLVDALYLVCGDRGFYFNDRGA GSSSRRGIVDECCHRSCDLRRLENYCN; SEQ ID NO: 145; ▲), DP30 (▼); and DP31 (♦) and ◄ native insulin (◄) at the insulin subtype A (FIG. 1A) and the insulin subtype B (FIG. 1B) receptors. The fusion peptide has a potency of about 2.07 nanomoles at the A receptor and about 9.9 nanomoles at the insulin B receptor. The activity of these compounds is significantly less than native insulin (as well as other non-conjugated insulin analogs) which has a potency of about 0.5 and 0.76 at the respective A and B receptors.

In describing and claiming the invention, the following terminology will be used in accordance with the definitions set forth below.

The term "about" as used herein means greater or lesser than the value or range of values stated by 10 percent, but is not intended to designate any value or range of values to only this broader definition. Each value or range of values preceded by the term "about" is also intended to encompass the embodiment of the stated absolute value or range of values.

As used herein the term "amino acid" encompasses any molecule containing both amino and carboxyl functional groups, wherein the amino and carboxylate groups are attached to the same carbon (the alpha carbon). The alpha carbon optionally may have one or two further organic substituents. For the purposes of the present disclosure designation of an amino acid without specifying its stereochemistry is intended to encompass either the L or D form of the amino acid, or a racemic mixture. However, in the instance where an amino acid is designated by its three letter code and includes a superscript number, the D form of the amino acid is specified by inclusion of a lower case d before the three letter code and superscript number (e.g., $dLys^{-1}$), wherein the designation lacking the lower case d (e.g., $Lys^{-1}$) is intended to specify the native L form of the amino acid. In this nomenclature, the inclusion of the superscript number designates the position of the amino acid in the insulin analog sequence, wherein amino acids that are located within the insulin analog sequence are designated by positive superscript numbers numbered consecutively from the N-terminus. Additional amino acids linked to the insulin analog peptide either at the N-terminus or through a side chain are numbered starting with 0 and increasing in negative integer value as they are further removed from the insulin analog sequence.

As used herein the term "hydroxyl acid" refers to amino acids that have been modified to replace the alpha carbon amino group with a hydroxyl group.

As used herein the term "non-coded amino acid" encompasses any amino acid that is not an L-isomer of any of the following 20 amino acids: Ala, Cys, Asp, Glu, Phe, Gly, His, Ile, Lys, Leu, Met, Asn, Pro, Gln, Arg, Ser, Thr, Val, Trp, Tyr.

A "bioactive polypeptide" refers to polypeptides which are capable of exerting a biological effect in vitro and/or in vivo.

As used herein a general reference to a peptide is intended to encompass peptides that have modified amino and carboxy termini. For example, an amino acid sequence designating the standard amino acids is intended to encompass standard amino acids at the N- and C-terminus as well as a corresponding hydroxyl acid at the N-terminus and/or a corresponding C-terminal amino acid modified to comprise an amide group in place of the terminal carboxylic acid.

As used herein an "acylated" amino acid is an amino acid comprising an acyl group which is non-native to a naturally-occurring amino acid, regardless by the means by which it is produced. Exemplary methods of producing acylated amino acids and acylated peptides are known in the art and include acylating an amino acid before inclusion in the peptide or peptide synthesis followed by chemical acylation of the peptide. In some embodiments, the acyl group causes the peptide to have one or more of (i) a prolonged half-life in circulation, (ii) a delayed onset of action, (iii) an extended duration of action, (iv) an improved resistance to proteases, such as DPP-IV, and (v) increased potency at the IGF and/or insulin peptide receptors.

As used herein, an "alkylated" amino acid is an amino acid comprising an alkyl group which is non-native to a naturally-occurring amino acid, regardless of the means by which it is produced. Exemplary methods of producing alkylated amino acids and alkylated peptides are known in the art and including alkylating an amino acid before inclusion in the peptide or peptide synthesis followed by chemical alkylation of the peptide. Without being held to any particular theory, it is believed that alkylation of peptides will achieve similar, if not the same, effects as acylation of the peptides, e.g., a prolonged half-life in circulation, a delayed onset of action, an extended duration of action, an improved resistance to proteases, such as DPP-IV, and increased potency at the IGF and/or insulin receptors.

As used herein, the term "pharmaceutically acceptable carrier" includes any of the standard pharmaceutical carriers, such as a phosphate buffered saline solution, water, emulsions such as an oil/water or water/oil emulsion, and various types of wetting agents. The term also encompasses any of the agents approved by a regulatory agency of the US Federal government or listed in the US Pharmacopeia for use in animals, including humans.

As used herein the term "pharmaceutically acceptable salt" refers to salts of compounds that retain the biological activity of the parent compound, and which are not biologically or otherwise undesirable. Many of the compounds disclosed herein are capable of forming acid and/or base salts by virtue of the presence of amino and/or carboxyl groups or groups similar thereto.

Pharmaceutically acceptable base addition salts can be prepared from inorganic and organic bases. Salts derived from inorganic bases, include by way of example only, sodium, potassium, lithium, ammonium, calcium and magnesium salts. Salts derived from organic bases include, but are not limited to, salts of primary, secondary and tertiary amines.

Pharmaceutically acceptable acid addition salts may be prepared from inorganic and organic acids. Salts derived from inorganic acids include hydrochloric acid, hydrobromic acid, sulfuric acid, nitric acid, phosphoric acid, and the like. Salts derived from organic acids include acetic acid, propionic acid, glycolic acid, pyruvic acid, oxalic acid, malic acid, malonic acid, succinic acid, maleic acid, fumaric acid, tartaric acid, citric acid, benzoic acid, cinnamic acid, mandelic acid, methanesulfonic acid, ethanesulfonic acid, p-toluene-sulfonic acid, salicylic acid, and the like.

As used herein, the term "hydrophilic moiety" refers to any compound that is readily water-soluble or readily absorbs water, and which are tolerated in vivo by mammalian species without toxic effects (i.e. are biocompatible). Examples of hydrophilic moieties include polyethylene glycol (PEG), polylactic acid, polyglycolic acid, a polylactic-polyglycolic acid copolymer, polyvinyl alcohol, polyvinylpyrrolidone, polymethoxazoline, polyethyloxazoline, polyhydroxyethyl methacrylate, polyhydroxypropyl methacrylamide, polymethacrylamide, polydimethylacrylamide, and derivatised celluloses and starches such as hydroxymethylcellulose, hydroxymethylstarchm, hydroxyethylstarch, or hydroxyethylcellulose and co-polymers thereof, as well as natural polymers including, for example, Fc, albumin, and other polypeptides, heparin and dextran.

As used herein, the term "treating" includes prophylaxis of the specific disorder or condition, or alleviation of the symptoms associated with a specific disorder or condition and/or preventing or eliminating said symptoms. For example, as used herein the term "treating diabetes" will refer in general to maintaining glucose blood levels near normal levels and may include increasing or decreasing blood glucose levels depending on a given situation.

As used herein an "effective" amount or a "therapeutically effective amount" of an insulin analog refers to a nontoxic but sufficient amount of an insulin analog to provide the desired effect. For example one desired effect would be the prevention or treatment of hyperglycemia. The amount that is "effective" will vary from subject to subject, depending on the age and general condition of the individual, mode of administration, and the like. Thus, it is not always possible to specify an exact "effective amount." However, an appropriate "effective" amount in any individual case may be determined by one of ordinary skill in the art using routine experimentation.

The term, "parenteral" means not through the alimentary canal but by some other route such as intranasal, inhalation, subcutaneous, intramuscular, intraspinal, or intravenous.

Throughout the application, all references to a particular amino acid position by letter and number (e.g. position A5) refer to the amino acid at that position of either the A chain (e.g. position A5) or the B chain (e.g. position B5) in the respective native human insulin A chain (SEQ ID NO: 1) or B chain (SEQ ID NO: 2), or the corresponding amino acid position in any analogs thereof. For example, a reference herein to "position B28" absent any further elaboration would mean the corresponding position B27 of the B chain of an insulin analog in which the first amino acid of SEQ ID NO: 2 has been deleted. Similarly, amino acids added to the N-terminus of the native B chain are numbered starting with B0, followed by numbers of increasing negative value (e.g., B-1, B-2 . . . ) as amino acids are added to the N-terminus. Alternatively, any reference to an amino acid position in the linking moiety of a single chain analog, is made in reference to the native C chain of IGF 1 (SEQ ID NO: 23). For example, position 9 of the native C chain (or the "position C9") has an alanine residue.

As used herein the term "native insulin peptide" is intended to designate the 51 amino acid heteroduplex comprising the A chain of SEQ ID NO: 1 and the B chain of SEQ ID NO: 2, as well as single-chain insulin analogs that comprise SEQ ID NOS: 1 and 2. The term "insulin peptide" as used herein, absent further descriptive language is intended to encompass the 51 amino acid heteroduplex comprising the A chain of SEQ ID NO: 1 and the B chain of SEQ ID NO: 2, as well as single-chain insulin analogs thereof (including for example those disclosed in published international application WO96/34882 and U.S. Pat. No. 6,630,348, the disclosures of which are incorporated herein by reference), including heteroduplexes and single-chain analogs that comprise modified analogs of the native A chain and/or B chain and derivatives thereof. Such modified analogs include modification of the amino acid at position A19, B16 or B25 to a 4-amino phenylalanine or one or more amino acid substitutions at positions selected from A5, A8, A9, A10, A12, A14, A15, A17, A18, A21, B1, B2, B3, B4, B5, B9, B10, B13, B14, B17, B20, B21, B22, B23, B26, B27, B28, B29 and B30 or deletions of any or all of positions B1-4 and B26-30. Insulin peptides as defined herein can also be analogs derived from a naturally occurring insulin by insertion or substitution of a non-peptide moiety, e.g. a retroinverso fragment, or incorporation of non-peptide bonds such as an azapeptide bond (CO substituted by NH) or pseudo-peptide bond (e.g. NH substituted with $CH_2$) or an ester bond (e.g., a depsipeptide, wherein one or more of the amide (—CONHR—) bonds are replaced by ester (COOR) bonds).

An "A19 insulin analog" is an insulin peptide that has a substitution of 4-amino phenylalanine or 4-methoxy phenylalanine for the native tyrosine residue at position 19 of the A chain of native insulin.

As used herein an "$IGF^{B16B17}$ analog peptide" is a generic term that comprising an A chain and B chain heteroduplex, as well as single-chain insulin analogs thereof, wherein the A chain comprises the peptide sequence of SEQ ID NO: 19 and the B chain comprises the sequence of SEQ ID NO: 20 as well as analogs of those sequences wherein the analog of the A chain and/or B chain comprise 1-3 further amino acid substitutions, with the proviso that the B chain does not comprise the sequence of SEQ ID NO: 2 and comprises a tyrosine at position B16 and a leucine at position B17.

An "IGF YL analog" is a peptide comprising an IGF A chain of SEQ ID NO: 19 and an IGF B chain of SEQ ID NO: 69.

As used herein, the term "single-chain insulin analog" encompasses a group of structurally-related proteins wherein insulin or IGF A and B chains, or analogs or derivatives thereof, are covalently linked to one another to form a linear polypeptide chain. As disclosed herein the single-chain insulin analog comprises the covalent linkage of the carboxy terminus of the B chain to the amino terminus of the A chain via a linking moiety.

As used herein the term "insulin A chain", absent further descriptive language is intended to encompass the 21 amino acid sequence of SEQ ID NO: 1 as well as functional analogs and derivatives thereof, including the A chain of A19 insulin analogs and other analogs known to those skilled in the art, including modification of the sequence of SEQ ID NO: 1 by one or more amino acid insertions, deletions or substitutions at positions selected from A4, A5, A8, A9, A10, A12, A14, A15, A17, A18, A21.

As used herein the term "insulin B chain", absent further descriptive language is intended to encompass the 30 amino acid sequence of SEQ ID NO: 2, as well as modified functional analogs of the native B chain, including modification of the amino acid at position B16 or B25 to a 4-amino phenylalanine or one or more amino acid insertions, deletions or substitutions at positions selected from B1, B2, B3, B4, B5, B9, B10, B13, B14, B17, B20, B21, B22, B23, B25, B26, B27, B28, B29 and B30 or deletions of any or all of positions B1-4 and B26-30.

The term "identity" as used herein relates to the similarity between two or more sequences. Identity is measured by dividing the number of identical residues by the total number of residues and multiplying the product by 100 to achieve a percentage. Thus, two copies of exactly the same sequence have 100% identity, whereas two sequences that have amino acid deletions, additions, or substitutions relative to one another have a lower degree of identity. Those skilled in the art will recognize that several computer programs, such as those that employ algorithms such as BLAST (Basic Local Alignment Search Tool, Altschul et al. (1993) J. Mol. Biol. 215:403-410) are available for determining sequence identity.

The terms "glucagon related peptide" and "incretin peptide" are used interchangeably and said terms encompass peptides which have biological activity as agonists at any one or more of the glucagon, GLP-1, GLP-2, and GIP receptors and comprise an amino acid sequence that shares at least 40% sequence identity (e.g., 45%, 50%, 55%, 60%, 65%, 70%, 75%, 80%, 85%, 90%, 95%) with at least one of native glucagon, native oxyntomodulin, native exendin-4, native GLP-1, native GLP-2, or native GIP. Unless otherwise stated, any reference to an amino acid position in a glucagon related peptide (e.g. for linkage of a prodrug moiety, a conjugate moiety, a hydrophilic polymer, acylation or alkylation) refers to the position relative to the native glucagon amino acid sequence (SEQ ID NO: 701).

As used herein reference to the C-terminal region of a glucagon related peptide is intended to encompass the native C-terminus of a glucagon peptide or any amino acid of a C-terminal extension of a glucagon analog that has been extended by the addition of one or more amino acids at the C-terminus, or the terminal amino acid of a glucagon analog that has been shortened by the deletion of one or more amino acids, respectively, relative to the native glucagon sequence. An insulin peptide conjugated at the C-terminal region of a glucagon related peptide is intended to include linkage to the side chain of an amino acid of the C-terminal region or linkage through the C-terminal carboxylic acid moiety.

The term "GLP-1 agonist" refers to a compound that stimulates GLP-1 receptor activity, as measured by cAMP production using a validated in vitro model assay, such as that described in Example 13 of published International Application No. WO 2007/056362, published on May 18, 2007, the disclosure of which is hereby expressly incorporated by reference into the present application.

As used herein the term "native glucagon" refers to a peptide consisting of the sequence of SEQ ID NO: 701, the term "native GIP" refers to a peptide consisting of the sequence of SEQ ID NO: 707, and the term "native GLP-1" is a generic term that designates GLP-1(7-36) amide (consisting of the sequence of SEQ ID NO: 704), GLP-1(7-37) acid (consisting of the sequence of SEQ ID NO: 703) or a mixture of those two compounds. As used herein, a general reference to "glucagon" or "GIP" or "GLP-1" in the absence of any further designation is intended to mean native glucagon or native GIP or native GLP-1, respectively.

As used herein the term "glucagon peptide" is a generic term that designates the natural glucagon peptide of SEQ ID NO: 701 as well as modified derivatives having one or more amino acid modifications relative to the native glucagon sequence, optionally including but not limited to substitutions at amino acid positions 1, 2, 5, 7, 8, 10, 12, 13, 14, 16, 17, 18, 24, 28 and 29. Generally, all references to a particular amino acid position by number (e.g. position 28) refer to the amino acid at that position in native glucagon (SEQ ID NO: 701) or the corresponding amino acid position in any analogs thereof. For example, a reference to "position 28" would mean the corresponding position 27 for a glucagon analog in which the first amino acid of SEQ ID NO: 701 has been deleted. Similarly, a reference to "position 28" would mean the corresponding position 29 for a glucagon analog in which one amino acid has been added before the N-terminus of SEQ ID NO: 701.

As used herein the term "GLP-1 peptide" is a generic term that designates native GLP-1 as well as modified derivatives having one or more amino acid modifications relative to the native GLP-1 sequence.

As used herein the term "derivative" is intended to encompass chemical modification to a compound (e.g., an amino acid), including chemical modification in vitro, e.g. by introducing a group in a side chain in one or more positions of a polypeptide, e.g. a nitro group in a tyrosine residue, or iodine in a tyrosine residue, or by conversion of a free carboxylic group to an ester group or to an amide group, or by converting an amino group to an amide by acylation, or by acylating a hydroxy group rendering an ester, or by alkylation of a primary amine rendering a secondary amine or linkage of a hydrophilic moiety to an amino acid side chain. Other derivatives are obtained by oxidation or reduction of the side-chains of the amino acid residues in the polypeptide.

As used herein, the term "selectivity" of a molecule for a first receptor relative to a second receptor refers to the following ratio: $EC_{50}$ of the molecule at the second receptor divided by the $EC_{50}$ of the molecule at the first receptor. For example, a molecule that has an $EC_{50}$ of 1 nM at a first receptor and an $EC_{50}$ of 100 nM at a second receptor has 100-fold selectivity for the first receptor relative to the second receptor.

As used herein an amino acid "modification" refers to a substitution of an amino acid, or the derivation of an amino acid by the addition and/or removal of chemical groups to/from the amino acid, and includes substitution with any of the 20 amino acids commonly found in human proteins, as well as atypical or non-naturally occurring amino acids. Commercial sources of atypical amino acids include Sigma-Aldrich (Milwaukee, Wis.), ChemPep Inc. (Miami, Fla.), and Genzyme Pharmaceuticals (Cambridge, Mass.). Atypical amino acids may be purchased from commercial suppliers, synthesized de novo, or chemically modified or derivatized from naturally occurring amino acids.

As used herein an amino acid "substitution" refers to the replacement of one amino acid residue by a different amino acid residue.

As used herein, the term "conservative amino acid substitution" is defined herein as exchanges within one of the following five groups:

I. Small aliphatic, nonpolar or slightly polar residues:
   Ala, Ser, Thr, Pro, Gly;
II. Polar, negatively charged residues and their amides:
   Asp, Asn, Glu, Gln, cysteic acid and homocysteic acid;
III. Polar, positively charged residues:
   His, Arg, Lys; Ornithine (Orn)
IV. Large, aliphatic, nonpolar residues:
   Met, Leu, Ile, Val, Cys, Norleucine (Nle), homocysteine
V. Large, aromatic residues:
   Phe, Tyr, Trp, acetyl phenylalanine As used herein the general term "polyethylene glycol chain" or "PEG chain", refers to mixtures of condensation polymers of ethylene oxide and water, in a branched or straight chain, represented by the general formula $H(OCH_2CH_2)_nOH$, wherein n is at least 2. "Polyethylene glycol chain" or "PEG chain" is used in combination with a numeric suffix to indicate the approximate average molecular weight thereof. For example, PEG-5,000 refers to polyethylene glycol chain having a total molecular weight average of about 5,000 Daltons.

As used herein the term "pegylated" and like terms refers to a compound that has been modified from its native state by linking a polyethylene glycol chain to the compound. A "pegylated polypeptide" is a polypeptide that has a PEG chain covalently bound to the polypeptide.

As used herein a "linker" is a bond, molecule or group of molecules that binds two separate entities to one another. Linkers may provide for optimal spacing of the two entities or may further supply a labile linkage that allows the two entities to be separated from each other. Labile linkages include photocleavable groups, acid-labile moieties, base-labile moieties and enzyme-cleavable groups.

As used herein a "dimer" is a complex comprising two subunits covalently bound to one another via a linker. The term dimer, when used absent any qualifying language, encompasses both homodimers and heterodimers. A homodimer comprises two identical subunits, whereas a heterodimer comprises two subunits that differ, although the two subunits are substantially similar to one another.

The term "$C_1$-$C_n$ alkyl" wherein n can be from 1 through 6, as used herein, represents a branched or linear alkyl group having from one to the specified number of carbon atoms. Typical $C_1$-$C_6$ alkyl groups include, but are not limited to, methyl, ethyl, n-propyl, iso-propyl, butyl, iso-Butyl, sec-butyl, tert-butyl, pentyl, hexyl and the like.

The terms "$C_2$-$C_n$ alkenyl" wherein n can be from 2 through 6, as used herein, represents an olefinically unsaturated branched or linear group having from 2 to the specified number of carbon atoms and at least one double bond. Examples of such groups include, but are not limited to, 1-propenyl, 2-propenyl (—$CH_2$—CH=$CH_2$), 1,3-butadienyl, (—CH=CHCH=$CH_2$), 1-butenyl (—CH=CHCH$_2$CH$_3$), hexenyl, pentenyl, and the like.

The term "$C_2$-$C_n$ alkynyl" wherein n can be from 2 to 6, refers to an unsaturated branched or linear group having from 2 to n carbon atoms and at least one triple bond. Examples of such groups include, but are not limited to, 1-propynyl, 2-propynyl, 1-butynyl, 2-butynyl, 1-pentynyl, and the like.

As used herein the term "aryl" refers to a mono- or bicyclic carbocyclic ring system having one or two aromatic rings including, but not limited to, phenyl, naphthyl, tetrahydronaphthyl, indanyl, indenyl, and the like. The size of the aryl ring and the presence of substituents or linking groups are indicated by designating the number of carbons present. For example, the term "($C_1$-$C_3$ alkyl)($C_6$-$C_{10}$ aryl)" refers to a 5 to 10 membered aryl that is attached to a parent moiety via a one to three membered alkyl chain.

The term "heteroaryl" as used herein refers to a mono- or bi-cyclic ring system containing one or two aromatic rings and containing at least one nitrogen, oxygen, or sulfur atom in an aromatic ring. The size of the heteroaryl ring and the presence of substituents or linking groups are indicated by designating the number of carbons present. For example, the term "($C_1$-$C_n$ alkyl)($C_5$-$C_6$ heteroaryl)" refers to a 5 or 6 membered heteroaryl that is attached to a parent moiety via a one to "n" membered alkyl chain.

As used herein, the term "halo" refers to one or more members of the group consisting of fluorine, chlorine, bromine, and iodine.

As used herein the term "patient" without further designation is intended to encompass any warm blooded vertebrate domesticated animal (including for example, but not limited to livestock, horses, cats, dogs and other pets) and humans.

The term "isolated" as used herein means having been removed from its natural environment. In some embodiments, the analog is made through recombinant methods and the analog is isolated from the host cell.

The term "purified," as used herein relates to the isolation of a molecule or compound in a form that is substantially free of contaminants normally associated with the molecule or compound in a native or natural environment and means having been increased in purity as a result of being separated from other components of the original composition. The term "purified polypeptide" is used herein to describe a polypeptide which has been separated from other compounds including, but not limited to nucleic acid molecules, lipids and carbohydrates.

A "peptidomimetic" refers to a chemical compound having a structure that is different from the general structure of an existing peptide, but that functions in a manner similar to the existing peptide, e.g., by mimicking the biological activity of that peptide. Peptidomimetics typically comprise naturally-occurring amino acids and/or unnatural amino acids, but can also comprise modifications to the peptide backbone. For example a peptidomimetic may include a sequence of naturally-occurring amino acids with the insertion or substitution of a non-peptide moiety, e.g. a retroinverso fragment, or incorporation of non-peptide bonds such as an azapeptide bond (CO substituted by NH) or pseudopeptide bond (e.g. NH substituted with CH2), or an ester bond (e.g., depsipeptides, wherein one or more of the amide (—CONHR—) bonds are replaced by ester (COOR) bonds). Alternatively the peptidomimetic may be devoid of any naturally-occurring amino acids.

As used herein the term "charged amino acid" or "charged residue" refers to an amino acid that comprises a side chain that is negatively charged (i.e., de-protonated) or positively charged (i.e., protonated) in aqueous solution at physiological pH. For example, negatively charged amino acids include aspartic acid, glutamic acid, cysteic acid, homocysteic acid, and homoglutamic acid, whereas positively charged amino acids include arginine, lysine and histidine. Charged amino acids include the charged amino acids among the 20 amino acids commonly found in human proteins, as well as atypical or non-naturally occurring amino acids.

As used herein the term "acidic amino acid" refers to an amino acid that comprises a second acidic moiety (other than the alpha carboxylic acid of the amino acid), including for example, a side chain carboxylic acid or sulfonic acid group.

As used herein the term "patient" without further designation is intended to encompass any warm blooded vertebrate domesticated animal (including for example, but not limited to livestock, horses, cats, dogs and other pets), mammals, and humans.

Abbreviations

Insulin analogs will be abbreviated as follows:

The insulin A and B chains will be designated by a capital A for the A chain and a capital B for the B chain. Modifications that deviate from the native insulin and IGF sequence are indicated in parenthesis following the designation of the A or B chain (e.g., [B$^1$(H5,H10,Y16,L17):A$^1$(H8,N18,N21)]) with the single letter amino acid abbreviation indicating the substitution and the number indicating the position of the substitution in the respective A or B chain, using native insulin numbering. A colon between the A and B chain indicates a two chain insulin whereas a dash will indicate a covalent bond and thus a single chain analog. In single chain analogs a linking moiety will be included between the A and B chains and the designation C1 refers to the native IGF 1 C peptide, SEQ ID NO: 23. The designation "position C8" in reference to the linking moiety designates an amino acid located at the position corresponding to the eighth amino acid of SEQ ID NO: 23.

Embodiments

Figure 1B:
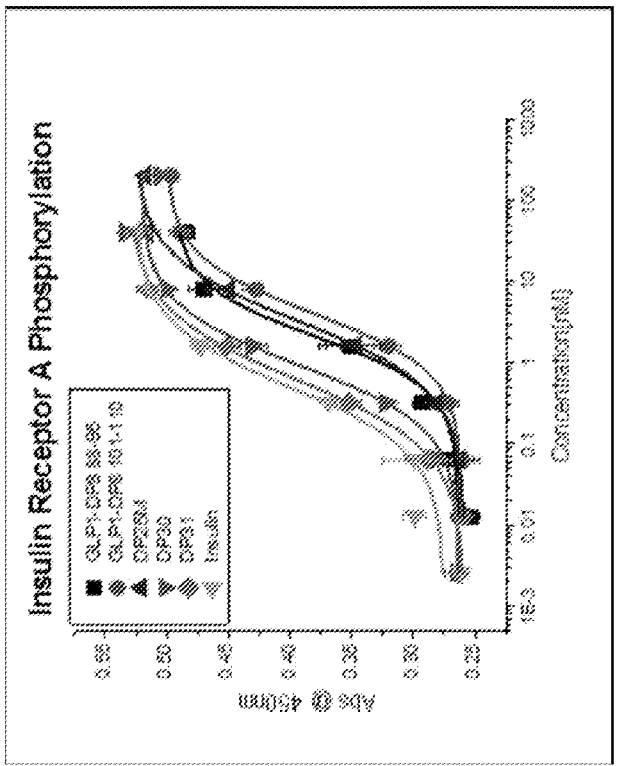

Disclosed herein are conjugates of an insulin peptide and a glucagon related peptide (an incretin) wherein the conjugate has activity in lowering blood glucose levels as well as inducing weight loss in a patient. Incretin-insulin conjugates (increlins) can be formed as peptide fusions where the carboxy terminus of the incretin is linked to the B chain of the insulin peptide. Such compounds have been found to exhibit activity at both the insulin and the respective incretin receptors. However, such conjugates have substantially reduced activity at the insulin receptor (see FIG. 1).

Applicants have found that usage of a non-peptide linear spacer to link an incretin to insulin produces a conjugate having full potency at the insulin receptor and at the increlin receptor. In particular, glucagon analogs have been previously described that exhibit co-agonist activity at the GLP-1 and glucagon receptors, or at the GLP-1 and GIP receptors, or tri-agonist activity at the glucagon, GLP-1 and GIP receptors. This coagonist and/or triagonist activity of the glucagon analog is retained, as well as insulin receptor activity, in the incretin-insulin conjugates disclosed herein. Advantageously, increlins disclosed herein have the ability to lower blood glucose and induce weight loss or prevent weight gain. In one embodiment the incretin-insulin conjugates of the present invention have at least 10 to 200, 50 to 150, or 70 to 100% the activity of native insulin at the insulin receptor, more particularly at the insulin subtype B receptor. In one embodiment the incretin-insulin conjugates of the present invention have at least 10 to 200, 50 to 150, or 70 to 100% the activity of native GLP-1 at the GLP-1 receptor, and/or at least 10 to 200, 50 to 150, or 70 to 100% the activity of native GIP at the GIP receptor. In one embodiment the incretin-insulin conjugates of the present invention have sub-nanomolar activity at both the GLP-1 and GIP receptors based on the in vitro assay of Example 9 and nanomolar activity at the insulin subtype B receptor based on the in vitro assay of Example 10.

In accordance with one embodiment the carboxy terminus of the incretin is linked via a spacer to 1) the side chain of an amino acid at position A14 or A15 of the A chain, 2) the amino N-terminus of the B chain, 3) to the side chain of an amino acid at position B1, B3, B10, B22, B28 or B29 of the B chain, or 4) at the side chain amino acid of any position of the linking moiety of a single chain insulin analog. In accordance with one embodiment the carboxy terminus of the incretin is linked via a spacer to the amino N-terminus of the B chain of the insulin peptide or to the side chain of the B28 or B29 amino acid. In accordance with one embodiment the carboxy terminus of the incretin is linked via a spacer to the N-terminal amine of the B chain of the insulin peptide.

In accordance with one embodiment an incretin-insulin conjugate is provided, comprising the general structure W-Y-Z, where W is an incretin, Z is an insulin peptide and Y is a spacer covalently linking W to Z. The incretin peptide can be any of the known incretins including for example native glucagon, GLP-1, or GIP, or an agonist analog of glucagon, GLP-1, or GIP, including a glucagon/GLP-1 co-agonist, a GIP/GLP-1 co-agonist, and a glucagon/GIP/GLP-1 tri-agonist. The insulin peptide can be any known insulin or insulin analog, including both two chain and single chain insulin analogs. The spacer linking the incretin and insulin peptides can be selected from any of the known linkers that are compatible with linking peptides to one another. In one embodiment the spacer comprises a moiety, selected from the group consisting of: amino, ether, thio-ether, maleimido, disulfide, selenoether, diselenium, amide, ester, thioester, alkene, cycloalkene, alkyne, trizoyl, carbamate, carbonate, cathepsin B-cleavable, oxime, and hydrazone, within the backbone of the linker chain.

In some embodiments, the spacer (Y) comprises a chain of atoms from 3 to 50, 3 to 25, 5 to 10 or 6 to 8 atoms in length. In some embodiments, the chain atoms in the backbone of the linker are selected from the group consisting of C, O, N, and S. Chain atoms and linkers may be selected according to their expected solubility (hydrophilicity) so as to provide a more soluble conjugate. In some embodiments, Y provides a functional group that is subject to cleavage by an enzyme or other catalyst or hydrolytic conditions found in the target tissue or organ or cell.

In some embodiments, Y is hydrolyzable in vivo. In these embodiments, Y comprises a functional group that is capable of undergoing hydrolysis in vivo. Nonlimiting examples of functional groups that are capable of undergoing hydrolysis in vivo include esters, anhydrides, and thioesters. In some embodiments, the spacer is metastable in vivo. In these embodiments, the spacer comprises a functional group that is capable of being chemically or enzymatically cleaved in vivo (e.g., an acid-labile, reduction-labile, or enzyme-labile functional group), optionally over a period of time. For example, Y can be selected to be stable in blood serum for at least 10, or 20, or 25, or 30, or 60, or 90, or 120 minutes, or 3, 4, 5, 6, 7, 8, 9, 10, 12, 15, 18 or 24 hours. In these embodiments, Y can comprise, for example, a hydrazone moiety, a disulfide moiety, or a cathepsin-cleavable moiety. When Y is metastable, and without intending to be bound by any particular theory, the W-Y-Z conjugate is stable in an extracellular environment, e.g., stable in blood serum for the time periods described above, but labile in the intracellular environment or conditions that mimic the intracellular environment, so that it cleaves upon entry into a cell. In some embodiments when Y is metastable, Y is stable in blood serum for at least about 24, 25, 26, 27, 28, 29, 30, 31, 32, 33, 34, 35, 36, 42, or 48 hours, or about 24-48, 48-72, 24-60, 36-48, 36-72, or 48-72 hours.

In accordance with one embodiment spacer Y is a linear chain of 6 to 8 atoms that comprises a disulfide, thioether, selenoeher, diselenium, thioether sulfoxide, oxime, hydrazone, triazole, alkyl, or alkene linkage within the backbone of the spacer linear chain. In accordance with one embodiment spacer Y is a linear chain of 6 to 8 atoms that comprises a disulfide, thioether, selenoether, diselenium, or oxime linkage within the backbone of the spacer linear chain. In accordance with one embodiment spacer Y is a linear chain of 6 to 8 atoms that comprises a disulfide, thioether, selenoether or diselenium linkage within the backbone of the spacer linear chain. In accordance with one embodiment the spacer has the general structure:

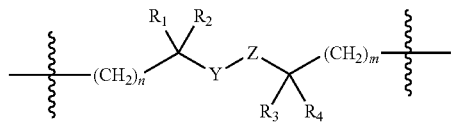

wherein $R_1$, $R_2$, $R_3$ and $R_4$ are independently selected from the group consisting of H, and $C_1$-$C_3$ alkyl;

Y is C, S, Se or S=O,

Z is C, S, Se, —S($C_1$-$C_3$)($C_5$-$C_6$ aryl)-, or Z in combination with Y is —C=C—, —O—N=, —N—N=, or a 1,2,3 triazole n is 0 or 1; and m is 1, 2 or 3, wherein when Y is S=O, Z is C. In one embodiment the spacer has the general structure of formula I wherein Y is C, S, or Se and Z is C, S, or Se, or Z in combination with Y is —O—N= or a 1,2,3 triazole, with the proviso that Y and Z are not both C. In one embodiment the spacer has the general structure of formula I wherein Y is C, S=O, or Se and Z is C, or Z in combination with Y is —O—N= or a 1, 2, 3 triazole. In one embodiment the spacer has the general structure of formula I wherein Y is S or Se and Z is C, S, or Se, or Z in combination with Y is —O—N= or a 1, 2, 3 triazole. In one embodiment the spacer has the general structure of formula I wherein Z in combination with Y is —O—N= or a 1, 2, 3 triazole. In one embodiment the spacer has the general structure of formula I wherein Z in combination with Y forms an oxime or a hydrazone. In one embodiment the spacer has the general structure of formula I wherein $R_1$, $R_2$, $R_3$ and $R_4$ are independently selected from the group consisting of H and CH; Y is C, S, or Se, Z is Se or S; n is 0 or 1; and m is 1, 2 or 3. In one embodiment the spacer has the general structure of formula I wherein $R_1$, $R_2$, $R_3$ and $R_4$ are independently selected from the group consisting of H and CH; Y and Z are independently selected from S and Se; n is 0 or 1; and m is 1, 2 or 3.

In accordance with one embodiment the spacer has the general structure of Formula I wherein $R_1$, $R_2$, $R_3$ and $R_4$ are independently selected from the group consisting of H, and $C_1$-$C_2$ alkyl, Y is S or S=O, Z is C or S, n is 0 or 1; and m is 1, 2 or 3, with the proviso that when Y is S=O, Z is C. In accordance with one embodiment the spacer has the general structure of Formula I wherein $R_1$, $R_2$, $R_3$ and $R_4$ are independently selected from the group consisting of H, and $CH_3$, Y is S, Z is C or S, n is 0 or 1; and m is 1, 2 or 3. In one embodiment the spacer comprises the general structure of Formula II:

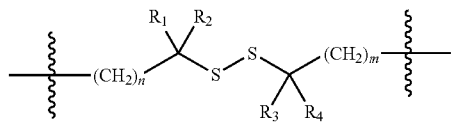

wherein $R_1$, $R_2$, $R_3$ and $R_4$ are independently selected from the group consisting of H, and $C_1$-$C_2$ alkyl, n is 0 or 1, and m is 1, 2 or 3. In one embodiment the $(CH_2)_nCR_1R_2S$ portion of the spacer represents the side chain of a C-terminal amino acid of the incretin, and in one embodiment (where n is 0 and $R_1$ and $R_2$ are each H) the C-terminal amino acid is cysteine. Furthermore, in one embodiment the —$SCR_1R_2(CH_2)_m$ portion of the spacer represents a thiol derivation of the N-terminus, or amino acid side chain, of the insulin B chain. Formation of the disulfide bond links the derivatized insulin to the incretin to form an increlin.

In one embodiment the spacer comprises the general structure of Formula II wherein $R_1$, $R_2$, $R_3$ and $R_4$ are independently selected from the group consisting of H, and $CH_3$, n is 0 or 1, and m is 1, 2 or 3. In one embodiment the spacer comprises the general structure of Formula II wherein $R_1$, $R_2$, $R_3$ and $R_4$ are independently selected from the group consisting of H, and $CH_3$, n is 0, and m is 1, 2 or 3. In one embodiment the spacer comprises the general structure of Formula II wherein $R_2$, and $R_3$ are both H, $R_1$ and $R_4$ are independently selected from the group consisting of H, and $CH_3$, n is 0 or 1, and m is 1, 2 or 3. In one embodiment the spacer comprises the general structure of Formula II wherein $R_2$, $R_3$ and $R_4$ are each H, $R_1$ is H or $CH_3$, n is 0 or 1, and m is 1 or 2. In one embodiment the spacer comprises the general structure of Formula II wherein $R_3$ and $R_4$ are each H, $R_1$ and $R_2$ are independently H or $CH_3$, n is 0, and m is 2. In one embodiment the spacer comprises the general structure of Formula II wherein $R_2$, $R_3$ and $R_4$ are each H, $R_1$ is H or $CH_3$, n is 0, and m is 2. In one embodiment $R_1$, $R_2$, $R_3$ and $R_4$ are each H, n is 0, and m is 1, 2 or 3.

In one embodiment the spacer comprises the general structure of Formula III:

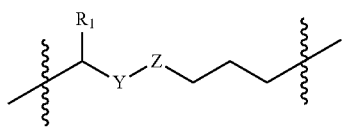

wherein $R_1$ is H or $CH_3$, Y is S, Se or S=O, Z is C, Se or S, wherein when Y is S=O, Z is C. In one embodiment the spacer comprises the general structure of Formula III, wherein $R_1$ is H or $CH_3$, Y is S and Z is S. In one embodiment the incretin-insulin conjugate comprises the structure:

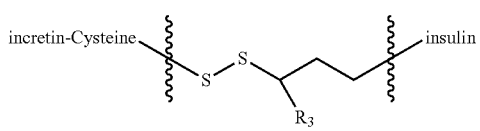

wherein $R_3$ is H or $CH_3$.

In one embodiment the incretin-insulin conjugate comprises a covalent linkage of the carboxy terminus of an incretin peptide to the amino or carboxy terminus of the insulin A chain or B chain via a spacer of the general Formula of I, II, III or IV. In another embodiment the N-terminus or C-terminus of an insulin peptide is covalently linked to the side chain of an amino acid of a incretin peptide at a position selected from 10, 20, 24, 28 and 29, optionally at position B29, via a spacer of Formula I, II, III or IV.

In another embodiment one or two incretin peptides are covalently linked to the insulin peptide through a position independently selected from the N-terminal alpha amine of the B chain, the carboxy terminus of the B chain or at any position of the linking moiety that links the A chain and B chain of a single chain insulin analog, including for example at position C8. In one embodiment the carboxy terminal region of the incretin peptide is covalently linked to the N-terminal alpha amine of the B chain of an insulin peptide. In one embodiment the carboxy terminus of the incretin peptide is covalently linked to the N-terminal alpha amine of the B chain of a two chain or single chain insulin peptide analog.

In accordance with one embodiment the insulin peptide is a two chain insulin, wherein the A chain and B chain are linked to one another via disulfide bonds. In one embodiment the conjugate comprises a two chain insulin peptide wherein the carboxy terminal region of the incretin peptide is covalently linked to the amino terminus of the A chain of the insulin peptide. In one embodiment the conjugate comprises a two chain insulin peptide wherein the carboxy terminus of the A chain or the B chain of the insulin peptide is covalently linked to the amino terminus of the incretin peptide. In one embodiment the conjugate comprises a two chain insulin peptide wherein the carboxy terminus of the incretin peptide is covalently linked to the N-terminal amine of the B chain of the insulin peptide. In one embodiment the conjugate comprises a two chain insulin peptide wherein the carboxy terminus of the B chain of the insulin peptide is covalently linked to the amino terminus of the incretin peptide. In each of these embodiments the linkage between the incretin peptide and the insulin peptide is via a spacer of the general Formula I, II, III or IV, wherein when linker IV is used the incretin peptide comprises a C-terminal cysteine.

In another embodiment the conjugate comprises a two chain insulin analog and a first and second incretin peptide wherein each incretin peptide is independently covalently linked to the insulin peptide at a position selected from the group consisting of the amino terminus of the B chain, the carboxy terminus of the A chain, and the carboxy terminus of the B chain. In one embodiment the conjugate comprises a two chain insulin peptide wherein the carboxy terminal region of a first incretin peptide is covalently linked to the amino terminus of the B chain of the insulin peptide and the carboxy terminus of the B chain of the insulin peptide is covalently linked to the amino terminus of a second incretin peptide. In one embodiment the first and second incretin peptides are different and have activity at two different receptors selected from the group consisting of the glucagon, GLP-1 and GIP receptors. In one embodiment the first incretin peptide has activity at the glucagon receptor and the second incretin peptide has activity at the GLP-1 receptor. In one embodiment the first and/or second incretin peptide is a coagonist having activity at two receptors selected from the group consisting of the glucagon, GLP-1 and GIP receptors. In each of these embodiments the linkage between the incretin peptide and the insulin peptide is via a spacer of the general Formula I, II, III or IV.

In some or any embodiments, the insulin peptide of the presently disclosed conjugate is native insulin, comprising the A chain of SEQ ID NO: 1 and the B chain of SEQ ID NO: 2, or an analog of native insulin, including for example a single-chain insulin analog comprising SEQ ID NOS: 1 and 2. In one embodiment the insulin peptide is an $IGF^{B16B17}$ analog peptide. In accordance with the present disclosure analogs of insulin encompass polypeptides comprising an A chain and a B chain wherein the insulin analogs differ from native insulin by one, two or three, or more amino acid substitutions at positions selected from A5, A8, A9, A10, A12, A14, A15, A17, A18, A21, B1, B2, B3, B4, B5, B9, B10, B13, B14, B17, B20, B21, B22, B23, B26, B27, B28, B29 and B30 or deletions of any or all of positions B1-4 and B26-30.

In one embodiment the incretin peptide component of the conjugate is a peptide selected from the group consisting of native glucagon (SEQ ID NO: 701), native GLP-1 (SEQ ID NO: 703 and/or 704) and native GIP (SEQ ID NO: 707). In one embodiment the incretin peptide comprises a C-terminal extension comprising the sequence GPSSGAPPPS (SEQ ID NO: 820), KRNRNNIA (SEQ ID NO: 821) or KRNR (SEQ ID NO: 822) linked to the carboxy terminal amino acid of the incretin peptide. In one embodiment the C-terminal extension is GPSSGAPPPS (SEQ ID NO: 820). In a further embodiment the incretin peptide comprises an aminoisobutyric acid at position 2, a C-terminal extension of GPSSGAPPPS (SEQ ID NO: 820) and an optional alkylation or acylation at position 10 and/or 40 with a $C_{10}$ to $C_{20}$ alkyl or acyl group, and further optionally pegylation at the side chain of an amino acid added (e.g., at position 40, relative to the native glucagon sequence) to the C-terminus of the incretin peptide. In one embodiment the incretin peptide is pegylated at the side chain of the amino acids at both positions 24 and 40. In one embodiment the incretin peptide is a glucagon peptide or GLP-1 peptide. In one embodiment the incretin peptide is a peptide selected from the group consisting of Y(aib)EGTFTSDYSIYLDKQAA(aib)EFVNWLLAGGPSSGAPPPS (SEQ ID NO: 1930), H(aib)QGTFTSDYSKYLDERAAQDFVQWLLDGGPSSGAPPPS (SEQ ID NO: 1931), H(aib)EGTFTSDVSSYLEEQAAKEFIAWLVKGGPSSGAPPPS (SEQ ID NO: 1932), HSQGTFTSDYSKYLDSRRAQDFVQWLMNTGPSSGAPPPS (SEQ ID NO: 2043), and Y(aib)EGTFISDYSIYLDRQAA(aib)EFVNWLLAGGPSSGAPPPS (SEQ ID NO: 2044), or a peptide that differs from SEQ ID NO: 1930, 1931, 1932, 2043 or 2044 by 1, 2 or three amino acid substitutions or additions, including for example a substitutions at position 10, optionally with lysine, and/or the addition of an amino acid at position 40, optionally lysine. In a further embodiment the lysine at position 10 and/or 40 is acylated and/or the added amino acid at position 40 is pegylated. In one embodiment the incretin peptide is a peptide selected from the group consisting of Y(aib)EGTFTSDYSIYLDKQAA(aib)EFVNWLLAGGPSSGAPPPS (SEQ ID NO: 1930), H(aib)QGTFTSDYSKYLDERAAQDFVQWLLDGGPSSGAPPPS (SEQ ID NO: 1931), and H(aib)EGTFTSDVSSYLEEQAAKEFIAWLVKGGPSSGAPPPS (SEQ ID NO: 1932). In one embodiment the incretin peptide is Y(aib)EGTFTSDYSIYLDKQAA(aib)EFVNWLLAGGPSSGAPPPS (SEQ ID NO: 1930), or H(aib)QGTFTSDYSKYLDERAAQDFVQWLLDGGPSSGAPPPS (SEQ ID NO: 1931). In one embodiment the incretin peptide is Y(aib)EGTFTSDYSIYLDKQAA(aib)EFVNWLLAGGPSSGAPPPS-amide (SEQ ID NO: 1930), or a peptide that differs from SEQ ID NO: 1930 by 1, 2 or three amino acid substitutions or additions, including for example a substitutions at position 10, optionally with lysine, and/or the addition of an amino acid at position 40. In a further embodiment the lysine at position 10 is acylated and/or the added amino acid at position 40 is pegylated. In one embodiment the incretin peptide is H(aib)QGTFTSDYSKYLDERAA Q DFVQWLLDGGPSSGAPPPS-amide (SEQ ID NO: 1931), or a peptide that differs from SEQ ID NO: 1931 by 1, 2 or three amino acid substitutions or additions, including for example substitutions at position 10, optionally with lysine, and/or the addition of an amino acid at position 40. In a further embodiment the lysine at position 10 is acylated and/or the added amino acid at position 40 is pegylated.

In some embodiments, the incretin peptide of the conjugate of the present disclosures is an analog of native human glucagon (SEQ ID NO: 701) comprising an amino acid sequence based on the amino acid sequence of SEQ ID NO: 701 but differing from SEQ ID NO: 701 by one or more (e.g., 1, 2, 3, 4, 5, 6, 7, 8, 9, 10, 11, 12, 13, 14, 15, and in some instances, 16 or more (e.g., 17, 18, 19, 20, 21, 22, 23, 24, 25, etc.), specified or optional amino acid modifications. In some or any embodiments, the peptide of the present disclosures comprises a total of 1, up to 2, up to 3, up to 4, up to 5, up to 6, up to 7, up to 8, up to 9, or up to 10 additional amino acid modifications (e.g., in addition to the specified amino acid modifications), relative to the native human glucagon sequence (SEQ ID NO: 701). For example, in one embodiment an analog of glucagon (SEQ ID NO: 701) comprises (a) an amino acid comprising an imidazole side chain at position 1, (b) an DPP-IV protective amino acid at position 2, (c) an acylated amino acid or alkylated amino acid at any of positions 9, 10, 12, 16, 20, or 37-43, (d) an alpha helix stabilizing amino acid at one or more of positions 16, 17, 18, 19, 20, and 21, and (e) up to ten additional amino acid modifications relative to SEQ ID NO: 701. In one embodiment the present disclosure provides an analog of glucagon comprising (a)-(d) with up to 10 additional amino acid modifications in addition to the amino acid modifications specified in (a)-(d). In some or any embodiments, the modifications are any of those described herein, e.g., acylation, alkylation, pegylation, truncation at C-terminus, substitution of the amino acid at one or more of positions 1, 2, 3, 7, 10, 12, 15, 16, 17, 18, 19, 20, 21, 23, 24, 27, 28, and 29.

In accordance with one embodiment an insulin agonist/incretin conjugate is provided comprising an incretin peptide and an insulin peptide, wherein the incretin peptide is linked to the insulin peptide via a linear chain spacer of 5 to 10 atoms, wherein the spacer comprises a disulfide, thioether, thioether sulfoxide, alkyl, alkene linkage within the backbone of the spacer linear chain. In one embodiment the C-terminal region of the incretin peptide is covalently linked to the insulin peptide through a position independently selected from the side chain of an amino acid at position B3, B28 or B29 of the B chain and the N-terminal alpha amine of the B chain. In one embodiment the insulin peptide of the conjugate comprises an A chain sequence of GIVEQCCX$_8$SICSLYQLENYCX$_{21}$ (SEQ ID NO: 3), or an analog thereof having 1 or 2 amino acid substitutions at a position selected from A5, A9, A10, A12, A14, A15, A17, A18, and a B chain sequence of R$_{22}$-HLCGSHLVEALYLVCGERGFX$_{45}$ (SEQ ID NO: 15), or an analog thereof having 1 or 2 amino acid substitutions at a position selected from B5, B9, B10, B13, B14, B17, B20, B21, B22 and B23 (positions relative to the native insulin) wherein the B chain is linked to the A chain through disulfide linkages; and R$_{22}$ is an amine, or a 1 to 4 amino acid sequence selected from the group consisting of a FVNQ (SEQ ID NO: 12), FVKQ (SEQ ID NO: 8), VNQ, NQ and Q;

X$_8$ is selected from the group consisting of threonine and histidine;

X$_{21}$ is selected from the group consisting of asparagine, lysine, glycine, alanine; and X$_{45}$ is histidine, tyrosine or phenylalanine. In one embodiment the insulin is linked to the incretin via a spacer of the general Formula I (as defined herein), wherein the incretin peptide comprises the sequence X$_{80}$X$_{81}$X$_{82}$GTFTSDX$_{95}$SX$_{83}$YLX$_{84}$X$_{85}$X$_{86}$X$_{87}$AX$_{88}$X$_{89}$FX$_{90}$X$_{91}$WLX$_{92}$X$_{93}$X$_{94}$-Z (SEQ ID NO: 1928), wherein X$_{80}$ is His, Tyr, D-histidine, desaminohistidine, hydroxyl-histidine, acetyl-histidine, homo-histidine or alpha, alpha-dimethyl imidiazole acetic acid (DMIA) N-methyl histidine, alpha-methyl histidine, or imidazole acetic acid; X$_{81}$ is Ser, D-serine, Ala, Val, glycine, N-methyl serine, aminoisobutyric acid (AIB), N-methyl alanine or D-alanine; $X_{82}$ is Gln or Glu; $X_{83}$ is Lys or Ile; $X_{84}$ is Asp or Glu; $X_{85}$ is Lys, Arg, Ser or Glu; $X_{86}$ is Arg or Gln; $X_{87}$ is Ala or Arg; $X_{88}$ is Aib, Gln or Lys; $X_{89}$ is Asp or Glu; $X_{90}$ is Val or Ile; $X_{91}$ is Asn, Gln or Ala; $X_{92}$ is Leu, Val or Met; $X_{93}$ is Asp, Lys Asn or Ala; $X_{94}$ is Gly or Thr; and Z is selected from the group consisting of —COOH, —CONH$_2$ and GPSSGAPPPS-CONH$_2$ (SEQ ID NO: 823) and $X_{95}$ is Tyr. In one embodiment $X_{80}$ is His or Tyr and $X_{86}$ is aib.

In one embodiment an incretin-insulin conjugate is provided wherein the C-terminal amino acid of the incretin peptides is covalently linked to the insulin peptide via a linear chain spacer at a position independently selected from the side chain of an amino acid at position B3, B28 or B29 of the B chain, and the N-terminal alpha amine of the B chain. In one embodiment the C-terminal amino acid of the incretin peptides is covalently linked to the insulin peptide via a linear chain spacer at the N-terminal alpha amine of the B chain. In accordance with one embodiment the insulin peptide comprises an A chain sequence of GIVEQCCTSICSLYQLENYCN-R$_{13}$ (SEQ ID NO: 1) and a B chain sequence of FVNQHL-CGSHLVEALYLVCGERGFFYTPKT (SEQ ID NO: 2), or an A chain and/or B chain that differs from SEQ ID NO: 1 and/or SEQ ID NO: 2 by 1, 2, or three amino acid substitutions, wherein the B chain is linked to the A chain through disulfide linkages;

a linear chain spacer comprising the general structure of Formula II:

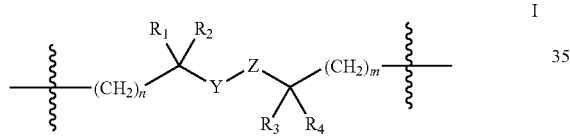

I wherein R$_1$, R$_2$, R$_3$ and R$_4$ are independently selected from the group consisting of H and CH$_3$, n is 0 or 1, m is 1, 2 or 3, Y is S, Se or C and Z is S or Se; or a linker of Formula IV:

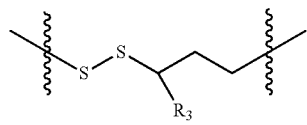

IV wherein R$_3$ is H or CH$_3$; and
the incretin peptide comprises the sequence $X_{80}X_{81}X_{82}$GTFTSDX$_{79}$SX$_{83}$YLX$_{84}X_{85}X_{86}X_{87}$AX$_{88}$X$_{89}$FX$_{90}$X$_{91}$WLX$_{92}$X$_{93}$X$_{94}$-Z$_1$ (SEQ ID NO: 1928), wherein
$X_{79}$ is an amino acid covalently attached to a C12 to C18 acyl or alkyl group;
$X_{80}$ is His, Tyr, D-histidine, desaminohistidine, hydroxyl-histidine, acetyl-histidine, homo-histidine or alpha, alpha-dimethyl imidiazole acetic acid (DMIA) N-methyl histidine, alpha-methyl histidine, or imidazole acetic acid;
$X_{81}$ is Ser, D-serine, Ala, Val, glycine, N-methyl serine or aminoisobutyric acid (AIB), N-methyl alanine and D-alanine;

$X_{82}$ is Gln or Glu;
$X_{83}$ is Lys or Ile;
$X_{84}$ is Asp or Glu;
$X_{85}$ is Lys, Arg, Ser or Glu;
$X_{86}$ is Arg or Gln;
$X_{87}$ is Ala or Arg;
$X_{88}$ is aminoisobutyric acid, Gln or Lys;
$X_{89}$ is Asp or Glu;
$X_{90}$ is Val or Ile;
$X_{91}$ is Asn, Gln or Ala;
$X_{92}$ is Leu, Val or Met;
$X_{93}$ is Asp, Lys Asn or Ala;
$X_{94}$ is Gly or Thr;
$X_{95}$ is a bond or Gly, and $Z_1$ is selected from the group consisting of —COOH, GPSSGAPPPS (SEQ ID NO: 820), KRNRNNIA (SEQ ID NO: 821), and KRNR (SEQ ID NO: 822). In one embodiment the incretin peptide comprises the sequence $X_{80}X_{81}X_{82}$GTFTSDX$_{79}$SX$_{83}$YLX$_{84}X_{85}X_{86}X_{87}$AX$_{88}$X$_{89}$FX$_{90}$X$_{91}$WLX$_{92}$X$_{93}$X$_{94}$-Z$_1$ (SEQ ID NO: 1928), wherein $X_{79}$ is an amino acid covalently attached to a C12 to C18 acyl or alkyl group, optionally lysine or; $X_{80}$ is His or Tyr, D-histidine, desaminohistidine, hydroxyl-histidine, acetyl-histidine, homo-histidine or alpha, alpha-dimethyl imidiazole acetic acid (DMIA) N-methyl histidine, alpha-methyl histidine, or imidazole acetic acid; $X_{81}$ is D-serine or aminoisobutyric acid (AIB); $X_{82}$ is Gln or Glu; $X_{83}$ is Lys or Ile; $X_{84}$ is Asp or Glu; $X_{85}$ is Lys, Arg, Ser or Glu; $X_{86}$ is Arg or Gln; $X_{87}$ is Ala or Arg; $X_{88}$ is aminoisobutyric acid, Gln or Lys; $X_{89}$ is Asp or Glu; $X_{90}$ is Val or Ile; $X_{91}$ is Asn, Gln or Ala; $X_{92}$ is Leu, Val or Met; $X_{93}$ is Ala, Asp, Lys Asn or Ala; $X_{94}$ is Gly or Thr; and $Z_1$ is selected from the group consisting of —COOH, GPSSGAPPPS (SEQ ID NO: 820), KRNRNNIA (SEQ ID NO: 821), and KRNR (SEQ ID NO: 822). In one embodiment $Z_1$ is SEQ ID NO: 820 (GPSSGAPPPS).

In accordance with one embodiment the insulin peptide comprises an A chain sequence of GIVEQCCTSICSLYQLENYCN-R$_{13}$ (SEQ ID NO: 1) and a B chain sequence of FVNQHL-CGSHLVEALYLVCGERGFFYTPKT (SEQ ID NO: 2), or an A chain and/or B chain that differs from SEQ ID NO: 1 and/or SEQ ID NO: 2 by 1, 2, or three amino acid substitutions, wherein the B chain is linked to the A chain through disulfide linkages;

a linear chain spacer comprising the general structure of Formula II:

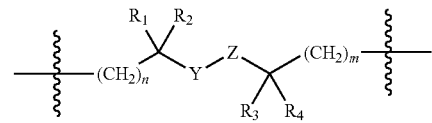

I wherein R$_1$, R$_2$, R$_3$ and R$_4$ are independently selected from the group consisting of H and CH$_3$, n is 0 or 1, m is 1, 2 or 3, Y is S, Se or C and Z is S or Se; or a linker of Formula IV:

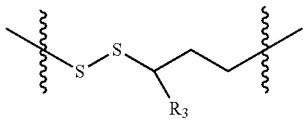

wherein $R_3$ is H or $CH_3$; and the incretin peptide comprises the sequence $X_{80}X_{81}X_{82}GTFTSDX_{79}SKYLX_{84}X_{85}X_{86}AAX_{88}X_{89}FVQWLX_{90}X_{91}X_{92}X_{93}X_{94}GPSSGAPPPS$ (SEQ ID NO: 1929)

wherein:

- $X_{79}$ is an amino acid covalently attached to a C12 to C18 acyl or alkyl group;
- $X_{80}$ is Tyr, His, D-histidine, desaminohistidine, hydroxyl-histidine, acetyl-histidine, homo-histidine or alpha, alpha-dimethyl imidazole acetic acid (DMIA), N-methyl histidine, alpha-methyl histidine, or imidazole acetic acid;
- $X_{81}$ is a DPP-IV protective amino acid, optionally, an alpha, alpha-disubstituted amino acid (e.g., AIB);
- $X_{82}$ is selected from the group consisting of Glu, Ala, Leu, Ile, Nle, Val, NorVal, homoserine, Met, methionine sulfoxide, methionine sulfone, acetyl-Orn, acetyl-diaminobutanoic acid, and acetyl-Lys;
- $X_{84}$ is an acidic amino acid, optionally, Glu or Asp;
- $X_{85}$ is Glu, Ala, alpha, alpha-disubstituted amino acid (e.g., AIB), His, Lys)
- $X_{86}$ is Arg, His, or Gln;
- $X_{88}$ is a selected from group consisting of: alpha, alpha-disubstituted amino acid (e.g., AIB) or Gln or His, Lys, or Ala;
- $X_{89}$ is an acidic amino acid, optionally, Asp or Glu;
- $X_{90}$ is Leu, Ala, or Nle;
- $X_{91}$ is Ala, Lys, or an acidic amino acid (optionally, Asp or Glu);
- $X_{92}$ is aliphatic, e.g., Ala or Gly or AIB or Val;
- $X_{93}$ is small aliphatic amino acid, e.g., Ala or Gly
- $X_{94}$ is Ala or a basic amino acid (optionally, Arg or Lys).

In a further embodiment the incretin peptide is a peptide selected from the group consisting of Y(aib)EGTFTSDYSIYLDKQAA(aib)EFVNWLLAGGPSSGAPPPS (SEQ ID NO: 1930), H(aib)QGTFTSDYSKYLDERAAQD-FVQWLLDGGPSSGAPPPS (SEQ ID NO: 1931), H(aib)EGTFTSDVSSYLEEQAAKEFIAWLVKGGPSSGAPPPS (SEQ ID NO: 1932), HSQGTFTSDYSKYLDSRRAQD-FVQWLMNTGPSSGAPPPS (SEQ ID NO: 2043), and Y(aib)EGTFISDYSIYLDRQAA(aib)EFVNWLLAG-GPSSGAPPPS (SEQ ID NO: 2044), or optionally a modification of the immediately above sequences, modified to comprise an amino acid covalently attached to a C12 to C18 acyl or alkyl group at position 10 or 40; and the spacer joining the incretin to the insulin peptide comprises the general structure of Formula II:

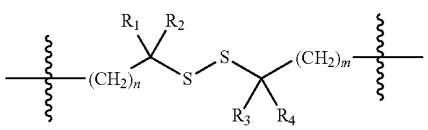

wherein $R_1$, $R_2$, $R_3$ and $R_4$ are independently selected from the group consisting of H, and $C_1$-$C_2$ alkyl, n is 0 or 1, and m is 1, 2 or 3. In one embodiment the spacer comprises the general structure of Formula II wherein $R_1$, $R_2$, $R_3$ and $R_4$ are independently selected from the group consisting of H, and $CH_3$, n is 1, and m is 2. In one embodiment the linker comprises the structure of Formula IV:

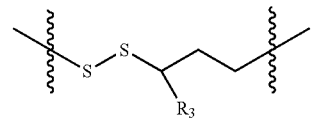

wherein $R_3$ is H or $CH_3$ and optionally $R_3$ is H. In one embodiment the linker consists of the structure of

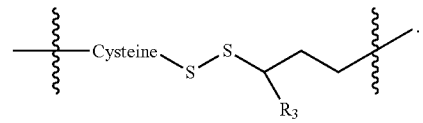

In one embodiment the insulin peptide of the insulin agonist/incretin conjugate comprises an A chain sequence of GIVEQCCTSICSLYQLENYCN-$R_{13}$ (SEQ ID NO: 1) and a B chain sequence selected from the group consisting of FVNQHLCGSHLVEALYLVCGERGFFYTPKT (SEQ ID NO: 2) FVNQHLCGSHLVEALYLVCGERGFFYTKPT (SEQ ID NO: 9) FVNQHLCGSHLVEALYL-VCGERGFFYTDKT (SEQ ID NO: 5) FVKQHLCG-SHLVEALYLVCGERGFFYTEKT (SEQ ID NO: 6).

In a further embodiment an insulin agonist/incretin conjugate is provided comprising the general structure X-Y-Z wherein X is an incretin peptide having the sequence $X_1X_2EGTFTSDX_{10}SIYLDKQAAX_{20}EFVNWLLAGGPSSGAPPPS$ (SEQ ID NO: 2037), $X_1X_2EGTFTSDVSIYLDKQAAX_{20}EFVNWLLAGGPSSGAPPPSX_{40}$(SEQ ID NO: 2038), Y(aib)EGTFTSDYSI-YLDKQAA(aib)EFVNWLLAGGPSSGAPPPS (SEQ ID NO: 1930), or H(aib)QGTFTSDYSKYLDERAAQD-FVQWLLDGGPSSGAPPPS (SEQ ID NO: 1931), wherein $X_1$ is His or Tyr; $X_2$ is aminoisobutyric acid; $X_{10}$ is Lys acylated with a C16 to C20 alkyl group optionally via a gamma Glu linker; $X_{20}$ is aminoisobutyric acid; and $X_{40}$ is is Lys acylated with a C16 to C20 alkyl group optionally via a gamma Glu linker;

X is the spacer joining the incretin to the insulin peptide, and comprising the general structure of Formula II:

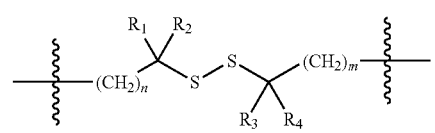

wherein $R_1$, $R_2$, $R_3$ and $R_4$ are independently selected from the group consisting of H, and $CH_3$, n is 0 or 1, and m is 1, 2 or 3; or the spacer comprises the general structure of Formula IV:

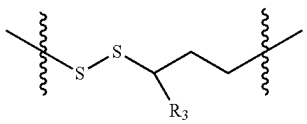

wherein R₃ is H or CH₃, and optionally R₃ is H; and Z is an insulin peptide comprising an A chain sequence of GIVEQCCTSICSLYQLENYCN-R₁₃ (SEQ ID NO: 1) and a B chain sequence selected from the group consisting of FVNQHLCGSHLVEALYLVCGERGFFYTPKT (SEQ ID NO: 2) FVNQHLCGSHLVEALYLVCGERGFFYTKPT (SEQ ID NO: 9) FVNQHLCGSHLVEALYLVCGERGFFYTDKT (SEQ ID NO: 5) FVKQHLCGSHLVEALYLVCGERGFFYTEKT (SEQ ID NO: 6).

In accordance with one embodiment the incretin-insulin conjugate is lipidated (e.g. the addition of a non-native acyl or alkyl group) or pegylated (addition of polyethylene glycol chain) at the side chain of an amino acid of said conjugate. In one embodiment the lipidation occurs at a position selected from positions 10, 16, 20, 30 or 40 of the incretin peptide (wherein positions 30 and 40 represent C-terminal extensions added to the incretin peptide relative to the native glucagon sequence) and/or at positions B28 or B29 of the insulin peptide. In one embodiment two sites selected from positions 10, 16, 20, 30 or 40 of the incretin peptide and positions B28 or B29 of the insulin peptide are lipidated. In one embodiment one or two sites selected from positions 10, 16, 20, 30 or 40 of the incretin peptide are lipidated. In one embodiment one or two sites selected from positions 10 and 40 of the incretin peptide are lipidated, optionally with an acyl group at one or two of those positions. In one embodiment the incretin peptide is acylated at position 10 with a C14-C18 acyl group. In one embodiment the incretin peptide comprises a non-native acyl or alkyl group of C14 to C30 or C14 to C20, or C16 to C20, covalently linked to a side chain at position 10 or 40 of the incretin peptide (based on the numbering of native glucagon). In one embodiment a C12, C, 13, C14, C15, C16, C17, C18, C19 or a C20 acyl or alkyl group is linked to the side chain of an amino acid at position 10 or 40, optionally through a linker such as gamma glutamic acid.

In one embodiment the incretin-insulin conjugate is pegylated at a position selected from positions 24, 30 or 40 of the incretin peptide (wherein positions 30 and 40 represent C-terminal extensions added to the incretin peptide relative to the native glucagon sequence) and/or at positions B28 or B29 of the insulin peptide. In one embodiment two sites selected from positions 24, 30 or 40 of the incretin peptide and positions B28 or B29 of the insulin peptide are pegylated. In one embodiment two sites selected from positions 24, 30 or 40 of the incretin peptide are pegylated. In one embodiment the incretin-insulin conjugate is pegylated at positions 24 and 40 of the incretin peptide. In one embodiment the incretin-insulin conjugate is pegylated only at position 40 of the incretin peptide.

In one embodiment the incretin-insulin conjugate comprises both lipidation and pegylation, wherein the incretin-insulin conjugate is lipidated at a position selected from 10, 16, 20, 30 or 40 of the incretin peptide or position B28 or B29 of the insulin peptide and pegylated at a position selected from 24, 30 or 40 of the incretin peptide or position B28 or B29 of the insulin peptide, provided that pegylation and lipidation occur at different positions. In one embodiment the incretin-insulin conjugate comprises both lipidation and pegylation, wherein the incretin-insulin conjugate is lipidated at position 10 and is pegylated at position 40.

In one embodiment an incretin-insulin conjugate is provided comprising an incretin peptide selected from the group consisting of X₁X₂EGTFTSDX₁₀SIYLDKQAAX₂₀EFVNWLLAGGPS SGAPPPS (SEQ ID NO: 2037) and X₁X₂EGTFTSDVSIYLDKQAAX₂₀EFVNWLLAGGPSS GAPPPSX₄₀ (SEQ ID NO: 2038), wherein
X₁ is His or Tyr;
X₂ is aminoisobutyric acid;
X₁₀ is Lys acylated with a C16 to C20 alkyl group optionally via a gamma Glu linker;
X₂₀ is aminoisobutyric acid; and
X₄₀ is Lys acylated with a C16 to C20 alkyl group optionally via a gamma Glu linker; an insulin peptide comprising
an A chain sequence of GIVEQCCX₈SICSLYQLENYCX₂₁ (SEQ ID NO: 3); and
a B chain sequence of R₂₂-HLCGSHLVEALYLVCGERGFX₄₅ (SEQ ID NO: 15), wherein the B chain is linked to the A chain through disulfide linkages; and
R₂₂ is a bond, or a 1 to 4 amino acid sequence selected from the group consisting of a FVNQ (SEQ ID NO: 12), FVKQ (SEQ ID NO: 8), VNQ, NQ and Q;
X₈ is selected from the group consisting of threonine and histidine;
X₂₁ is selected from the group consisting of asparagine, lysine, glycine, alanine; and
X₄₅ is histidine, tyrosine or phenylalanine; and a linear chain spacer joining the incretin to the insulin peptide, wherein the spacer comprises the general structure of

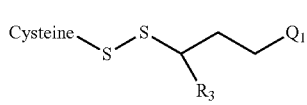

wherein the cysteine amino acid of the linear chain spacer is linked to the carboxy terminus of the incretin via an amide bond and Q₁ is the N-terminus of the insulin B chain. In a further embodiment the insulin peptide comprises an A chain sequence of GIVEQCCTSICSLYQLENYCN-R₁₃ (SEQ ID NO: 1); and a B chain sequence selected from the group consisting of FVNQHLCGSHLVEALYLVCGERGFFYTPKT (SEQ ID NO: 2), FVNQHLCGSHLVEALYLVCGERGFFYTKPT (SEQ ID NO: 9), FVNQHLCGSHLVEALYLVCGERGFFYTDKT (SEQ ID NO: 5) and FVKQHLCGSHLVEALYLVCGERGFFYTEKT (SEQ ID NO: 6). In one embodiment the insulin component is a two chain insulin.

In one embodiment the incretin comprises the general structure of

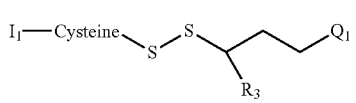

wherein I₁ is an incretin selected from the group consisting of SEQ ID NOs: 1987, 1993, 2014, and 2015, linked via its carboxy terminus to the cysteine of Formula V via an amide bond and $Q_1$ is an insulin peptide linked via the N-terminus of the B chain, wherein the A chain comprises a sequence of GIVEQCCTSICSLYQLENYCN-$R_{13}$ (SEQ ID NO: 1); and the B chain comprises a sequence selected from the group consisting of FVNQHLCGSHLVEALYLVCGERGFFYT-PKT (SEQ ID NO: 2), FVNQHLCGSHLVEALYL-VCGERGFFYTKPT (SEQ ID NO: 9), FVNQHLCG-SHLVEALYLVCGERGFFYTDKT (SEQ ID NO: 5) and FVKQHLCGSHLVEALYLVCGERGFFYTEKT (SEQ ID NO: 6), or an increlin that differs from SEQ ID NOs: 1987, 1993, 2014, and 2015 by 1 or 2 amino acid substitutions and/or an insulin A chain that differs from SEQ ID NO: 1 by 1 or 2 amino acid substitutions and/or an insulin B chain that differs from SEQ ID NO: 2 by 1 or 2 amino acid substitutions.

Insulin Peptides

The insulin peptide component of the conjugates of the present disclosure may comprise the native B and A chain sequences of human insulin (SEQ ID NOs: 1 and 2, respectively) or any of the known analogs or derivatives thereof that exhibit insulin agonist activity when linked to one another in a heteroduplex. Such analogs include, for example, proteins having an A-chain and a B-chain that differ from the A-chain and B-chain of human insulin by having one or more amino acid deletions, one or more amino acid substitutions, and/or one or more amino acid insertions that do not destroy the insulin activity of the insulin analog. The insulin peptide component of the conjugate can include, for example, any insulin peptide disclosed in published international applications WO96/34882, WO 2010/080607, WO 2010/080609, WO 2011/159882, WO/2011/159895 and U.S. Pat. No. 6,630,348, the disclosures of which are incorporated herein by reference.

In one embodiment the insulin peptide is an insulin analog wherein:

(a) the amino acid residue at position B28 is substituted with Asp, Lys, Leu, Val, or Ala, and the amino acyl residue at position B29 is Lys or Pro;

(b) the amino acid residues at any of positions B27, B28, B29, and B30 are deleted or substituted with a nonnative amino acid. In one embodiment an insulin analog is provided comprising an Asp substituted at position B28, or a Lys substituted at position 28 and a proline substituted at position B29. Additional insulin analogs are disclosed in Chance, et al., U.S. Pat. No. 5,514,646; Chance, et al., U.S. patent application Ser. No. 08/255,297; Brems, et al., Protein Engineering, 5:527-533 (1992); Brange, et al., EPO Publication No. 214,826 (published Mar. 18, 1987); and Brange, et al., Current Opinion in Structural Biology, 1:934-940 (1991). The disclosures of which are expressly incorporated herein by reference.

Insulin analogs may also have replacements of the amidated amino acids with acidic forms. For example, Asn may be replaced with Asp or Glu. Likewise, Gln may be replaced with Asp or Glu. In particular, Asn(A18), Asn(A21), or Asp(B3), or any combination of those residues, may be replaced by Asp or Glu. Also, Gln(A15) or Gln(B4), or both, may be replaced by either Asp or Glu.

As disclosed herein single chain insulin agonists are provided comprising a B chain and an A chain of human insulin, or analogs or derivative thereof, wherein the carboxy terminus of the B chain is linked to the amino terminus of the A chain via a linking moiety. In one embodiment the A chain is an amino acid sequence selected from the group consisting of GIVEQCCTSICSLYQLENYCN (SEQ ID NO: 1), GIVDECCFRSCDLRRLEMYCA (SEQ ID NO: 68) or GIVEECCFRSCDLALLETYCA (SEQ ID NO: 70) and the B chain comprises the sequence FVNQHLCG-SHLVEALYLVCGERGFFYTPKT (SEQ ID NO: 2), GPETLCGAELVDALYLVCGDRGFYFNKPT (SEQ ID NO: 69) or AYRPSETLCGGELVDTLYLVCGDRGFYF-SRPA (SEQ ID NO: 71), or a carboxy shortened sequence thereof having one to five amino acids corresponding to B26, B27, B28, B29 and B30 deleted, and analogs of those sequences wherein each sequence is modified to comprise one to five amino acid substitutions at positions corresponding to native insulin positions (see peptide alignment shown in FIG. 1) selected from A5, A8, A9, A10, A14, A15, A17, A18, A21, B1, B2, B3, B4, B5, B9, B10, B13, B14, B20, B22, B23, B26, B27, B28, B29 and B30. In one embodiment the amino acid substitutions are conservative amino acid substitutions. Suitable amino acid substitutions at these positions that do not adversely impact insulin's desired activities are known to those skilled in the art, as demonstrated, for example, in Mayer, et al., Insulin Structure and Function, Biopolymers. 2007; 88(5):687-713, the disclosure of which is incorporated herein by reference.

Additional amino acid sequences can be added to the amino terminus of the B chain or to the carboxy terminus of the A chain of the single chain insulin agonists of the present invention. For example, a series of negatively charged amino acids can be added to the amino terminus of the B chain, including for example a peptide of 1 to 12, 1 to 10, 1 to 8 or 1 to 6 amino acids in length and comprising one or more negatively charged amino acids including for example glutamic acid and aspartic acid. In one embodiment the B chain amino terminal extension comprises 1 to 6 charged amino acids. In accordance with one embodiment the incretin-insulin conjugates disclosed herein comprise a C-terminal amide or ester in place of a C-terminal carboxylate on the A chain.

High potency incretin-insulin conjugates can also be prepared based on using a modified IGF I and IGF II sequence described in published International application no. WO 2010/080607, the disclosure of which is expressly incorporated herein by reference, as the insulin peptide component. More particularly, analogs of IGF I and IGF II that comprise a substitution of a tyrosine leucine dipeptide for the native IGF amino acids at positions corresponding to B16 and B17 of native insulin have a tenfold increase in potency at the insulin receptor.

In accordance with one embodiment the insulin peptide for use in the present disclosure comprises a B chain sequence of $R_{22}$-$X_{25}$LCGX$_{29}$X$_{30}$LVX$_{33}$X$_{34}$LYLVCGX$_{41}$X$_{42}$GFX$_{45}$ (SEQ ID NO: 20) and an A chain sequence of GIVX$_4$X$_5$CCX$_8$X$_9$X$_{10}$CX$_{12}$LX$_{14}$X$_{15}$LX$_{17}$X$_{18}$YCX$_{21}$-$R_{44}$ (SEQ ID NO: 19) wherein $X_4$ is glutamic acid or aspartic acid;

$X_5$ is glutamine or glutamic acid $X_8$ is histidine, threonine or phenylalanine;

$X_9$ is serine, arginine, lysine, ornithine or alanine;

$X_{10}$ is isoleucine or serine;

$X_{12}$ is serine or aspartic acid $X_{14}$ is tyrosine, arginine, lysine, ornithine or alanine;

$X_{15}$ is glutamine, glutamic acid, arginine, alanine, lysine, ornithine or leucine;

$X_{17}$ is glutamine, glutamic acid, arginine, aspartic acid or lysine, ornithine $X_{18}$ is methionine, asparagine, glutamine, aspartic acid, glutamic acid or threonine;

$X_{21}$ is selected from the group consisting of alanine, glycine, serine, valine, threonine, isoleucine, leucine, glutamine, glutamic acid, asparagine, aspartic acid, histidine, tryptophan, tyrosine, and methionine;

$X_{25}$ is histidine or threonine;

$X_{29}$ is selected from the group consisting of alanine, glycine and serine;

$X_{30}$ is selected from the group consisting of histidine, aspartic acid, glutamic acid, homocysteic acid and cysteic acid;

$X_{33}$ is selected from the group consisting of aspartic acid, glutamine and glutamic acid;

$X_{34}$ is selected from the group consisting of alanine and threonine;

$X_{41}$ is selected from the group consisting of glutamic acid, aspartic acid or asparagine;

$X_{42}$ is selected from the group consisting of alanine, lysine, ornithine and arginine;

$X_{45}$ is tyrosine, histidine, asparagine or phenylalanine;

$R_{22}$ is selected from the group consisting of AYRPSE (SEQ ID NO: 14), FVNQ (SEQ ID NO: 12), PGPE (SEQ ID NO: 11), a tripeptide glycine-proline-glutamic acid, a tripeptide valine-asparagine-glutamine, a dipeptide proline-glutamic acid, a dipeptide asparagine-glutamine, glutamine, glutamic acid and a bond; and $R_{13}$ is COOH or $CONH_2$. In one embodiment the A chain and the B chain are linked to one another by disulfide bonds, including those that form between the A and B chains of native insulin. In an alternative embodiment the A and B chains are linked together as a linear single chain-insulin peptide.

In accordance with one embodiment an insulin analog is provided wherein the A chain of the insulin peptide comprises the sequence GIVEQCCX$_5$SICSLYQLENYCX$_{21}$R$_{13}$ (SEQ ID NO: 3) or an analog thereof having 1 or 2 amino acid substitutions at a position selected from A5, A9, A10, A12, A14, A15, A17, A18, and the B chain comprising the sequence R$_{22}$-X$_{25}$LCGX$_{29}$X$_{30}$LVX$_{33}$X$_{34}$LYLVCGX$_{41}$X$_{42}$GFX$_{45}$YT-Z-B$_1$ (SEQ ID NO: 67), wherein $X_8$ is selected from the group consisting of threonine and histidine;

$X_{21}$ is asparagine or glycine;

$X_{25}$ is histidine or threonine;

$X_{29}$ is selected from the group consisting of alanine, glycine and serine;

$X_{30}$ is selected from the group consisting of histidine, aspartic acid, glutamic acid, homocysteic acid and cysteic acid;

$X_{33}$ is selected from the group consisting of aspartic acid and glutamic acid;

$X_{34}$ is selected from the group consisting of alanine and threonine;

$X_{41}$ is selected from the group consisting of glutamic acid, aspartic acid or asparagine;

$X_{42}$ is selected from the group consisting of alanine, ornithine, lysine and arginine;

$X_{45}$ is tyrosine or phenylalanine;

$R_{22}$ is selected from the group consisting of FVNQ (SEQ ID NO: 12), a tripeptide valine-asparagine-glutamine, a dipeptide asparagine-glutamine, glutamine and an N-terminal amine $Z_1$ is a dipeptide selected from the group consisting of aspartate-lysine, lysine-proline, and proline-lysine; and $B_1$ is selected from the group consisting of threonine, alanine or a threonine-arginine-arginine tripeptide.

Single Chain Insulin Peptide Agonists

As disclosed herein linking moieties can be used to link human insulin A and B chains, or analogs or derivatives thereof, wherein the carboxy terminus of the B25 amino acid of the B chain is directly linked to a first end of a linking moiety, wherein the second end of the linking moiety is directly linked to the amino terminus of the A1 amino acid of the A chain via the intervening linking moiety.

In accordance with one embodiment the insulin peptide is a single chain insulin agonist that comprises the general structure B-LM-A wherein B represents an insulin B chain, A represents an insulin A chain, and LM represents a linking moiety linking the carboxy terminus of the B chain to the amino terminus of the A chain. Suitable linking moieties for joining the B chain to the A chain are disclosed herein under the header Linking Moieties for Single Chain-Insulin Analogs and the respective subheaders "Peptide linkers" and "Non-Peptide Linkers". In one embodiment the linking moiety comprises a linking peptide, and more particularly, in one embodiment the peptide represents an analog of the IGF-1 C peptide. Amino acid positions of the linking moiety are designated based on the corresponding position in the native C chain of IGF 1 (SEQ ID NO: 17). In another embodiment the peptide linking moiety comprises a 29 contiguous amino acid sequence having greater than 70%, 80%, 90% sequence identity to SSSSX$_{50}$APPPSLPSPSRLPGPSDTPILPQX$_{51}$ (SEQ ID NO: 1924), wherein $X_{50}$ and $X_{51}$ are independently selected from arginine and lysine. In one embodiment the linking moiety is a non-peptide linker comprising a relatively short bifunctional non-peptide polymer linker that approximates the length of an 8-16 amino acid sequence. In one embodiment the non-peptide linker has the structure:

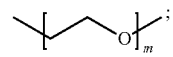

wherein m is an integer ranging from 10 to 14 and the linking moiety is linked directly to the B25 amino acid of the B chain. In accordance with one embodiment the non-peptide linking moiety is a polyethylene glycol linker of approximately 4 to 20, 8 to 18, 8 to 16, 8 to 14, 8 to 12, 10 to 14, 10 to 12 or 11 to 13 monomers.

In one embodiment a incretin-insulin conjugate is provided that comprises an insulin peptide having the structure: IB-LM-IA, wherein IB comprises the sequence R$_{22}$-X$_{25}$LCGX$_{29}$X$_{30}$LVX$_{33}$X$_{34}$LYLVCGX$_{41}$X$_{42}$GFX$_{45}$ (SEQ ID NO: 20), LM is a linking moiety as disclosed herein that covalently links IB to IA, and IA comprises the sequence GIVX$_4$X$_5$CCX$_8$X$_9$X$_{10}$CX$_{12}$LX$_{14}$X$_{15}$LX$_{17}$X$_{18}$YCX$_{21}$-R$_{44}$ (SEQ ID NO: 19), wherein $X_4$ is glutamic acid or aspartic acid;

$X_5$ is glutamine or glutamic acid;

$X_5$ is histidine or phenylalanine;

$X_9$ is selected from arginine, lysine, ornithine or alanine;

$X_{10}$ is isoleucine or serine;

$X_{12}$ is serine or aspartic acid;

$X_{14}$ is tyrosine, arginine, lysine, ornithine or alanine;

$X_{15}$ is arginine, lysine, ornithine or leucine;

$X_{17}$ is glutamic acid or glutamine;

$X_{18}$ is methionine, asparagine or threonine;

$X_{21}$ is alanine, glycine or asparagine;

$X_{25}$ is selected from the group consisting of histidine and threonine;

$X_{29}$ is selected from the group consisting of alanine, glycine and serine;

$X_{30}$ is selected from the group consisting of histidine, aspartic acid, glutamic acid, homocysteic acid and cysteic acid;

$X_{33}$ is selected from the group consisting of aspartic acid and glutamic acid;

$X_{34}$ is selected from the group consisting of alanine and threonine;

$X_{41}$ is selected from the group consisting of glutamic acid, aspartic acid or asparagine;

$X_{42}$ is selected from the group consisting of alanine, lysine, ornithine and arginine;

$R_{22}$ is selected from the group consisting of AYRPSE (SEQ ID NO: 14), FVNQ (SEQ ID NO: 12), PGPE (SEQ ID NO: 11), a tripeptide glycine-proline-glutamic acid, a tripeptide valine-asparagine-glutamine, a dipeptide proline-glutamic acid, a dipeptide asparagine-glutamine, glutamine, glutamic acid and an N-terminal amine; and $R_{13}$ is COOH or $CONH_2$, further wherein the amino acid at the designation $X_{45}$ is directly bound to the linking moiety, LM (i.e., the designation IB-LM-IA as used herein is intended to represent that the B chain carboxyl terminus and the amino terminus of the A chain are directly linked to the linking moiety LM without any further intervening amino acids).

In one embodiment the linking moiety (LM) comprises an amino acid sequence of no more than 17 amino acids in length. In one embodiment the linking moiety comprises the sequence GYGSSSRR (SEQ ID NO: 61), GYGSSSRRAPQT (SEQ ID NO: 23) or GAGSSSRRAPQT (SEQ ID NO: 64)

In another embodiment the linking moiety comprises a 29 contiguous amino acid sequence, directly linked to the carboxy terminal amino acid of the B chain, wherein said 29 contiguous amino acid sequence has greater than 70%, 80%, 90% sequence identity to SSSS$X_{50}$APPPSLPSPSRLPGPSDTPILPQ$X_{51}$ (SEQ ID NO: 1924), wherein $X_{50}$ and $X_{51}$ are independently selected from arginine and lysine. In one embodiment the linking peptide comprises a total of 29 to 158 or 29 to 58 amino acids and comprises the sequence of SEQ ID NO: 68. In another embodiment the linking moiety comprises a 29 contiguous amino acid sequence, directly linked to the carboxy terminal amino acid of the B chain, wherein said 29 contiguous amino acid sequence has greater than 90% sequence identity to SSSS$X_{50}$APPPSLPSPSRLPGPSDTPILPQ$X_{51}$ (SEQ ID NO: 1924), wherein $X_{50}$ and $X_{51}$ are independently selected from arginine and lysine. In one embodiment the linking moiety comprises the sequence SSSSRAPPPSLPSPSRLPGPSDTPILPQK (SEQ ID NO: 1923) or SSSSKAPPPSLPSPSRLPGPSDTPILPQR (SEQ ID NO: 1922) optionally with one or two amino acid substitutions.

In accordance with one embodiment a single chain insulin agonist polypeptide is provided comprising a B chain and A chain of human insulin, or analogs or derivative thereof, wherein the last five carboxy amino acids of the native B chain are deleted (i.e., B26-B30), and amino acid B25 is linked to amino acid A1 of the A chain via an intervening linking moiety. In one embodiment the linking moiety comprises the structure:

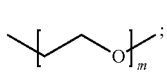

;

wherein m is an integer ranging from 10 to 14 and the linking moiety is linked directly to the B25 amino acid of the B chain.

In one embodiment an incretin-insulin conjugate is provided comprising an insulin peptide having the general formula IB-LM-IA wherein IB comprises the sequence $X_{25}$LCG$X_{29}X_{30}$LV$X_{33}X_{34}$LYLVCG$X_{41}X_{42}$GF$X_{45}$ (SEQ ID NO: 20); LM comprises the sequence SSSSRAPPPSLPSPSRLPGPSDTPILPQK (SEQ ID NO: 1923), SSSSKAPPPSLPSPSRLPGPSDTPILPQR (SEQ ID NO: 1922), GYGSSSRR (SEQ ID NO: 61) or GAGSSSRR (SEQ ID NO: 1925); and IA comprises the sequence GIV$X_4X_5$CC$X_8X_9X_{10}$C$X_{12}$L$X_{14}X_{15}$L$X_{17}X_{18}$YC$X_{21}$-$R_{44}$ (SEQ ID NO: 19) wherein $X_4$ is glutamic acid or aspartic acid;

$X_5$ is glutamine or glutamic acid $X_8$ is histidine, threonine or phenylalanine;

$X_9$ is serine, arginine, lysine, ornithine or alanine;

$X_{10}$ is isoleucine or serine;

$X_{12}$ is serine or aspartic acid;

$X_{14}$ is tyrosine, arginine, lysine, ornithine or alanine;

$X_{15}$ is glutamine, glutamic acid, arginine, alanine, lysine, ornithine or leucine;

$X_{17}$ is glutamic acid, aspartic acid, asparagine, lysine, ornithine or glutamine;

$X_{18}$ is methionine, asparagine, glutamine, aspartic acid, glutamic acid or threonine;

$X_{21}$ is selected from the group consisting of alanine, glycine, serine, valine, threonine, isoleucine, leucine, glutamine, glutamic acid, asparagine, aspartic acid, histidine, tryptophan, tyrosine, and methionine;

$X_{25}$ is histidine or threonine;

$X_{29}$ is selected from the group consisting of alanine, glycine and serine;

$X_{30}$ is selected from the group consisting of histidine, aspartic acid, glutamic acid, homocysteic acid and cysteic acid;

$X_{33}$ is selected from the group consisting of aspartic acid and glutamic acid;

$X_{34}$ is selected from the group consisting of alanine and threonine;

$X_{41}$ is selected from the group consisting of glutamic acid, aspartic acid or asparagine;

$X_{42}$ is selected from the group consisting of alanine, ornithine, lysine and arginine;

$X_{45}$ is tyrosine or phenylalanine;

$R_{22}$ is selected from the group consisting of AYRPSE (SEQ ID NO: 14), FVNQ (SEQ ID NO: 12), FVKQ (SEQ ID NO: 8), PGPE (SEQ ID NO: 11), a tripeptide glycine-proline-glutamic acid, a tripeptide valine-asparagine-glutamine, a dipeptide proline-glutamic acid, a dipeptide asparagine-glutamine, glutamine, glutamic acid and an N-terminal amine; and $R_{44}$ is COOH or $CONH_2$ Glycosylation During nascent in vivo protein production insulin analogs comprising glycosylation sites may undergo further processing, known as post-translational modification, wherein sugar (glycosyl) residues may be added enzymatically in a process known as glycosylation. The resulting proteins bearing covalently linked oligosaccharide side chains are known as glycosylated proteins or glycoproteins. Accordingly, a protein that bears a glycosylation site is not necessarily glycosylated. In accordance with one embodiment insulin agonists analogs are provided that have been modified to comprise a peptide sequence that is prone to hyperglycosylation when expressed in a eukaryotic expression system.

Non-native and native glycosylation sequences are known to those skilled in the art and include N-linked glycosylation sites, and O-linked glycosylation sites. N-linked glycosylation sites are peptide sequences that serve as recognition sites for enzymatic attachment of a carbohydrate moiety to the side chain of an asparagine residue. The tripeptide O-linked glycosylation sequences include asparagine-X-serine and asparagine-X-threonine, where X is any amino acid except proline. Thus, the presence of either of these tripeptide sequences in a polypeptide creates a potential glycosylation site. O-linked glycosylation are peptide sequences that serve as recognition sites for enzymatic attachment of a carbohydrate moiety to the side chain of a hydroxyamino acid, most commonly serine or threonine, although 5-hydroxyproline or 5-hydroxylysine may also be used. In one embodiment the O-linked glycosylation sugar is N-aceylgalactosamine, galactose, or xylose. A number of O-linked glycosylation sites are known in the art and have been reported in the literature. See, e.g., Ten Hagen et al. (11029) J. Biol. Chem. 274(39):27867-74; Hanisch et al. (2001) Glycobiology 11:731-740; and Ten Hagen et al. (2003) Glycobiology 13:1R-16R.

In accordance with one embodiment a method of producing a hyperglycosylated insulin analog is provided. The method comprises providing a eukaryotic host cell that comprises a gene encoding an insulin analog that has been modified to include a non-native glycosylation site (e.g., a CTP peptide sequence) and culturing the cell under conditions that allow expression of the insulin analog gene. In one embodiment the host cell expresses human glycosylation enzymes such that glycosylated proteins (glycoproteins) produced in the host cell exhibit protein glycosylation identical to that of human cells (see US Patent Application Publication Nos. 2004/0018590 and 2002/0137134, the disclosures of which are incorporated herein by reference). In accordance with one embodiment the eukaryotic host cell is selected from yeast (e.g., *Pichia pastoris*) or mammalian (CHO or HEK293) cells.

In one embodiment a glycosylation site is introduced by the addition of amino acid sequences to the base insulin analog. More particularly, applicants have discovered that peptide sequence named C-terminal peptide (CTP: SSSSKAPPPSLPSPSRLPGPSDTPILPQR; SEQ ID NO: 1922), which is prone to O-linked hyperglycosylation when the protein is expressed in a eukaryotic cellular expression system can be covalently linked to an insulin analog without undermining the inherent in vitro activity of the insulin analog.

In accordance with one embodiment an insulin analog is provided comprising A chain and a B chain and a CTP peptide, wherein the CTP peptide is a peptide having at least 60, 70, 80, 85, 90, or 95% sequence identity with (SEQ ID NO: 1922). In one embodiment the CTP peptide is a peptide comprising a 18 to 29 amino acid sequence that shares at least 80, 82, 84, 86, 88, 90, 92, 94, 96 or 98% sequence identity with a 18 to 29 amino acid region of (SEQ ID NO: 1922). In one embodiment the CTP peptide comprises an analog of (SEQ ID NO: 1922), wherein said analog differs from (SEQ ID NO: 1922) by 1, 1 to 2, 3 to 4, 4 to 6 or up to 8 amino acid substitutions. In one embodiment the amino acid substitution are at one or more positions selected from 1-4, 7-15, 18, 20, 21, 24 and 27 of (SEQ ID NO: 1922). In one embodiment the amino acid substitution are at one or more positions selected from 1, 2, 3, 4, 10, 13, 15, and 21 of (SEQ ID NO: 1922). In one embodiment the amino acid substitution are at one or more positions selected from 7, 8, 9, 12, 14, 18, 20, 24 and 27 of (SEQ ID NO: 1922). In one embodiment the CTP peptide comprises a 29 amino acids sequence that differs from SEQ ID NO: 1922 by 1 to 2 amino acid substitutions. In a further embodiment the CTP peptide comprises a fragment of SEQ ID NO: 1922 wherein the fragment represents a 18 to 28 contiguous amino acid sequence identical to an amino acid sequence contained within SEQ ID NO: 1922.

Pegylation of Insulin Peptides

Applicants have discovered that covalent linkage of a hydrophilic moiety to the peptide or incretin of the incretin-insulin conjugate disclosed herein provide analogs having slower onset, extended duration and exhibit a basal profile of activity. In one embodiment, the incretin-insulin conjugates disclosed herein are further modified to comprise a hydrophilic moiety covalently linked to the side chain of an amino acid at a position selected from the group consisting of 24, 30 or 40 of the incretin peptide, and/or position A9, A14 and A15 of the A chain, at the N-terminal alpha amine of the B chain or at the side chain of an amino acid at position B1, B2, B3, B10, B22, B28 or B29 of the B chain or at any position of the linking moiety that links the A chain and B chain in an insulin single chain analog, or any combination thereof. In exemplary embodiments, this hydrophilic moiety is covalently linked to a Lys, Cys, Orn, homocysteine, or acetyl-phenylalanine residue at any of these positions. In one embodiment the insulin peptide is a single chain analog and the hydrophilic moiety is covalently linked to the side chain of an amino acid of the linking moiety joining the A and B chains.

Exemplary hydrophilic moieties include polyethylene glycol (PEG), for example, of a molecular weight of about 1,000 Daltons to about 40,000 Daltons, or about 20,000 Daltons to about 40,000 Daltons. Additional suitable hydrophilic moieties include, polypropylene glycol, polyoxyethylated polyols (e.g., POG), polyoxyethylated sorbitol, polyoxyethylated glucose, polyoxyethylated glycerol (POG), polyoxyalkylenes, polyethylene glycol propionaldehyde, copolymers of ethylene glycol/propylene glycol, monomethoxy-polyethylene glycol, mono-(C1-C10) alkoxy- or aryloxy-polyethylene glycol, carboxymethylcellulose, polyacetals, polyvinyl alcohol (PVA), polyvinyl pyrrolidone, poly-1,3-dioxolane, poly-1,3,6-trioxane, ethylene/maleic anhydride copolymer, poly (beta-amino acids) (either homopolymers or random copolymers), poly(n-vinyl pyrrolidone)polyethylene glycol, propropylene glycol homopolymers (PPG) and other polyakylene oxides, polypropylene oxide/ethylene oxide copolymers, colonic acids or other polysaccharide polymers, Ficoll or dextran and mixtures thereof.

The hydrophilic moiety, e.g., polyethylene glycol chain in accordance with some embodiments has a molecular weight selected from the range of about 500 to about 40,000 Daltons. In one embodiment the hydrophilic moiety, e.g. PEG, has a molecular weight selected from the range of about 500 to about 5,000 Daltons, or about 1,000 to about 5,000 Daltons. In another embodiment the hydrophilic moiety, e.g., PEG, has a molecular weight of about 10,000 to about 20,000 Daltons. In yet other exemplary embodiment the hydrophilic moiety, e.g., PEG, has a molecular weight of about 20,000 to about 40,000 Daltons. In one embodiment the hydrophilic moiety, e.g. PEG, has a molecular weight of about 20,000 Daltons. In one embodiment an insulin peptide is provided wherein one or more amino acids of the analog are pegylated, and the combined molecular weight of the covalently linked PEG chains is about 20,000 Daltons.

In one embodiment dextrans are used as the hydrophilic moiety. Dextrans are polysaccharide polymers of glucose subunits, predominantly linked by al-6 linkages. Dextran is available in many molecular weight ranges, e.g., about 1 kD to about 100 kD, or from about 5, 10, 15 or 20 kD to about 20, 30, 40, 50, 60, 70, 80 or 90 kD.

Linear or branched polymers are contemplated. Resulting preparations of conjugates may be essentially monodisperse or polydisperse, and may have about 0.5, 0.7, 1, 1.2, 1.5 or 2 polymer moieties per peptide.

In one embodiment the hydrophilic moiety is a polyethylene glycol (PEG) chain, linked to the side chain of an amino acid at a position selected from the group consisting of 24, 30 or 40 of the incretin peptide, and/or at the side chain of an amino acid at position B28 or B29 of the B chain or at any position of the linking moiety that links the A chain and B chain in an insulin single chain analog, or any combination thereof. In one embodiment the incretin-insulin conjugate is pegylated at one, two or more amino acids at a position selected from the group consisting of 24, 30 or 40 of the incretin peptide, or at the side chain of an amino acid at position B1, B2, B3, B10, B22, B28 or B29 of the B chain or any combination thereof. In one embodiment the total molecular weight of the covalently linked PEG chain(s) is about 20,000 Daltons.

Hydrophilic moieties such as polyethylene glycol can be attached to the incretin-insulin conjugate under any suitable conditions used to react a protein with an activated polymer molecule. Any means known in the art can be used, including via acylation, reductive alkylation, Michael addition, thiol alkylation or other chemoselective conjugation/ligation methods through a reactive group on the PEG moiety (e.g., an aldehyde, amino, ester, thiol, α-haloacetyl, maleimido or hydrazino group) to a reactive group on the target compound (e.g., an aldehyde, amino, ester, thiol, α-haloacetyl, maleimido or hydrazino group). Activating groups which can be used to link the water soluble polymer to one or more proteins include without limitation sulfone, maleimide, sulfhydryl, thiol, triflate, tresylate, azidirine, oxirane and 5-pyridyl. If attached to the peptide by reductive alkylation, the polymer selected should have a single reactive aldehyde so that the degree of polymerization is controlled. See, for example, Kinstler et al., *Adv. Drug. Delivery Rev.* 54: 477-485 (2002); Roberts et al., *Adv. Drug Delivery Rev.* 54: 459-476 (2002); and Zalipsky et al., *Adv. Drug Delivery Rev.* 16: 157-182 (1995).

Acylation

In some embodiments, the insulin peptide or incretin of the incretin-insulin conjugate is modified to comprise an acyl group. The acyl group can be covalently linked directly to an amino acid of the incretin-insulin conjugate, or indirectly to an amino acid of the incretin-insulin conjugate via a spacer, wherein the spacer is positioned between the amino acid of the incretin-insulin conjugate and the acyl group. The incretin-insulin conjugate may be acylated at the same amino acid position where a hydrophilic moiety is linked, or at a different amino acid position. For example, acylation may occur at any position including any of positions 10, 16, 30 or 40 of the incretin peptide or any amino acid of the A or B chains as well as a position within the linking moiety, provided that the activity exhibited by the non-acylated incretin-insulin conjugate is retained upon acylation. Non-limiting examples include acylation at positions A14 and A15 of the A chain, or positions B1, B10, B22, B28 or B29 of the B chain or at any position of the linking moiety. Additional nonlimiting examples include acylation at positions 10, 16, and 20, as well as 30 or 40 for C-terminal extended incretin peptides.

In accordance with one embodiment the incretin of the incretin-insulin conjugate comprises a substitution of the native amino acid Tyr at position 10 with an amino acid of Formula Ia:

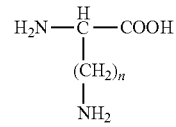

wherein n=1 to 4, comprising a side chain covalently linked to an acyl group or alkyl group. In one embodiment n is 4.

In one specific aspect of the invention, the insulin analog is modified to comprise an acyl group by direct acylation of an amine, hydroxyl, or thiol of a side chain of an amino acid of the incretin-insulin conjugate. In some embodiments, the insulin analog is directly acylated through the side chain amine, hydroxyl, or thiol of an amino acid. In some embodiments, acylation is at position B28 or B29 (according to the amino acid numbering of the native insulin A and B chain sequences). In this regard, an insulin analog can be provided that has been modified by one or more amino acid substitutions in the A or B chain sequence, including for example at positions A14, A15, B1, B2, B10, B22, B28 or B29 (according to the amino acid numbering of the native insulin A and B chain sequences) or at any position of the linking moiety with an amino acid comprising a side chain amine, hydroxyl, or thiol. In some specific embodiments of the invention, the direct acylation of the insulin peptide occurs through the side chain amine, hydroxyl, or thiol of the amino acid at position B28 or B29 (according to the amino acid numbering of the native insulin A and B chain sequences).

In accordance with one embodiment, the acylated insulin analogs comprise a spacer between the peptide and the acyl group. In some embodiments, the incretin-insulin conjugate is covalently bound to the spacer, which is covalently bound to the acyl group. In some exemplary embodiments, the insulin peptide is modified to comprise an acyl group by acylation of an amine, hydroxyl, or thiol of a spacer, which spacer is attached to a side chain of an amino acid at position B28 or B29 (according to the amino acid numbering of the A or B chain of native insulin), or at any position of the spacer moiety. The amino acid of the incretin-insulin conjugate to which the spacer is attached can be any amino acid comprising a moiety which permits linkage to the spacer. For example, an amino acid comprising a side chain —NH$_2$, —OH, or —COOH (e.g., Lys, Orn, Ser, Asp, or Glu) is suitable.

In some embodiments, the spacer between the incretin-insulin conjugate and the acyl group is an amino acid comprising a side chain amine, hydroxyl, or thiol (or a dipeptide or tripeptide comprising an amino acid comprising a side chain amine, hydroxyl, or thiol). In some embodiments, the spacer comprises a hydrophilic bifunctional spacer. In a specific embodiment, the spacer comprises an amino poly(alkyloxy)carboxylate. In this regard, the spacer can comprise, for example, NH$_2$(CH$_2$CH$_2$O)$_n$(CH$_2$)$_m$COOH, wherein m is any integer from 1 to 6 and n is any integer from 2 to 12, such as, e.g., 8-amino-3,6-dioxaoctanoic acid, which is commercially available from Peptides International, Inc. (Louisville, Ky.). In one embodiment, the hydrophilic bifunctional spacer comprises two or more reactive groups, e.g., an amine, a hydroxyl, a thiol, and a carboxyl group or any combinations thereof. In certain embodiments, the hydrophilic bifunctional spacer comprises a hydroxyl group and a carboxylate. In other embodiments, the hydrophilic bifunctional spacer comprises an amine group and a carboxylate. In other embodiments, the hydrophilic bifunctional spacer comprises a thiol group and a carboxylate.

In some embodiments, the spacer between peptide the incretin-insulin conjugate and the acyl group is a hydrophobic bifunctional spacer. Hydrophobic bifunctional spacers are known in the art. See, e.g., Bioconjugate Techniques, G. T. Hermanson (Academic Press, San Diego, Calif., 1996), which is incorporated by reference in its entirety. In accordance with certain embodiments the bifunctional spacer can be a synthetic or naturally occurring amino acid comprising an amino acid backbone that is 3 to 10 atoms in length (e.g., 6-amino hexanoic acid, 5-aminovaleric acid, 7-aminoheptanoic acid, and 8-aminooctanoic acid). Alternatively, the spacer can be a dipeptide or tripeptide spacer having a peptide backbone that is 3 to 10 atoms (e.g., 6 to 10 atoms) in length. Each amino acid of the dipeptide or tripeptide spacer attached to the incretin-insulin conjugate can be independently selected from the group consisting of: naturally-occurring and/or non-naturally occurring amino acids, including, for example, any of the D or L isomers of the naturally-occurring amino acids (Ala, Cys, Asp, Glu, Phe, Gly, His, Ile, Lys, Leu, Met, Asn, Pro, Arg, Ser, Thr, Val, Trp, Tyr), or any D or L isomers of the non-naturally occurring amino acids selected from the group consisting of: β-alanine (β-Ala), N-α-methyl-alanine (Me-Ala), aminobutyric acid (Abu), α-aminobutyric acid (γ-Abu), aminohexanoic acid (ε-Ahx), aminoisobutyric acid (Aib), aminomethylpyrrole carboxylic acid, aminopiperidinecarboxylic acid, aminoserine (Ams), aminotetrahydropyran-4-carboxylic acid, arginine N-methoxy-N-methyl amide, β-aspartic acid (β-Asp), azetidine carboxylic acid, 3-(2-benzothiazolyl)alanine, α-tert-butylglycine, 2-amino-5-ureido-n-valeric acid (citrulline, Cit), β-Cyclohexylalanine (Cha), acetamidomethyl-cysteine, diaminobutanoic acid (Dab), diaminopropionic acid (Dpr), dihydroxyphenylalanine (DOPA), dimethylthiazolidine (DMTA), γ-Glutamic acid (γ-Glu), homoserine (Hse), hydroxyproline (Hyp), isoleucine N-methoxy-N-methyl amide, methyl-isoleucine (MeIle), isonipecotic acid (Isn), methyl-leucine (MeLeu), methyl-lysine, dimethyl-lysine, trimethyl-lysine, methanoproline, methionine-sulfoxide (Met(O)), methionine-sulfone (Met(O2)), norleucine (Nle), methyl-norleucine (Me-Nle), norvaline (Nva), ornithine (Orn), para-aminobenzoic acid (PABA), penicillamine (Pen), methylphenylalanine (MePhe), 4-Chlorophenylalanine (Phe(4-Cl)), 4-fluorophenylalanine (Phe(4-F)), 4-nitrophenylalanine (Phe(4-NO2)), 4-cyanophenylalanine ((Phe (4-CN)), phenylglycine (Phg), piperidinylalanine, piperidinylglycine, 3,4-dehydroproline, pyrrolidinylalanine, sarcosine (Sar), selenocysteine (Sec), U-Benzyl-phosphoserine, 4-amino-3-hydroxy-6-methylheptanoic acid (Sta), 4-amino-5-cyclohexyl-3-hydroxypentanoic acid (ACHPA), 4-amino-3-hydroxy-5-phenylpentanoic acid (AHPPA), 1,2, 3,4,-tetrahydro-isoquinoline-3-carboxylic acid (Tic), tetrahydropyranglycine, thienylalanine (Thi), U-Benzyl-phosphotyrosine, O-Phosphotyrosine, methoxytyrosine, ethoxytyrosine, O-(bis-dimethylamino-phosphono)-tyrosine, tyrosine sulfate tetrabutylamine, methyl-valine (Me-Val), 1-amino-1-cyclohexane carboxylic acid (Acx), aminovaleric acid, beta-cyclopropyl-alanine (Cpa), propargylglycine (Prg), allylglycine (Alg), 2-amino-2-cyclohexyl-propanoic acid (2-Cha), tertbutylglycine (Tbg), vinylglycine (Vg), 1-amino-1-cyclopropane carboxylic acid (Acp), 1-amino-1-cyclopentane carboxylic acid (Acpe), alkylated 3-mercaptopropionic acid, 1-amino-1-cyclobutane carboxylic acid (Acb). In some embodiments the dipeptide spacer is selected from the group consisting of: Ala-Ala, β-Ala-β-Ala, Leu-Leu, Pro-Pro, γ-aminobutyric acid-γ-aminobutyric acid, and γ-Glu-γ-Glu.

The peptide the incretin-insulin conjugate can be modified to comprise an acyl group by acylation of a long chain alkane of any size and can comprise any length of carbon chain. The long chain alkane can be linear or branched. In certain aspects, the long chain alkane is a $C_4$ to $C_{30}$ alkane. For example, the long chain alkane can be any of a $C_4$ alkane, $C_6$ alkane, $C_8$ alkane, $C_{10}$ alkane, $C_{12}$ alkane, $C_{14}$ alkane, $C_{16}$ alkane, $C_{18}$ alkane, $C_{20}$ alkane, $C_{22}$ alkane, $C_{24}$ alkane, $C_{26}$ alkane, $C_{28}$ alkane, or a $C_{30}$ alkane. In some embodiments, the long chain alkane comprises a $C_8$ to $C_{20}$ alkane, e.g., a $C_{14}$ alkane, $C_{16}$ alkane, or a $C_{18}$ alkane.

In some embodiments, an amine, hydroxyl, or thiol group of the incretin-insulin conjugate is acylated with a cholesterol acid. In a specific embodiment, the peptide is linked to the cholesterol acid through an alkylated des-amino Cys spacer, i.e., an alkylated 3-mercaptopropionic acid spacer. Suitable methods of peptide acylation via amines, hydroxyls, and thiols are known in the art. See, for example, Miller, Biochem Biophys Res Commun 218: 377-382 (1996); Shimohigashi and Stammer, Int J Pept Protein Res 19: 54-62 (1982); and Previero et al., Biochim Biophys Acta 263: 7-13 (1972) (for methods of acylating through a hydroxyl); and San and Silvius, J Pept Res 66: 169-180 (2005) (for methods of acylating through a thiol); Bioconjugate Chem. "Chemical Modifications of Proteins: History and Applications" pages 1, 2-12 (1990); Hashimoto et al., Pharmaceutical Res. "Synthesis of Palmitoyl Derivatives of Insulin and their Biological Activity" Vol. 6, No: 2 pp. 171-176 (1989).

The acyl group of the acylated peptide the incretin-insulin conjugate can be of any size, e.g., any length carbon chain, and can be linear or branched. In some specific embodiments of the invention, the acyl group is a $C_4$ to $C_{30}$ fatty acid. For example, the acyl group can be any of a $C_4$ fatty acid, $C_6$ fatty acid, $C_8$ fatty acid, $C_{10}$ fatty acid, $C_{12}$ fatty acid, $C_{14}$ fatty acid, $C_{16}$ fatty acid, $C_{18}$ fatty acid, $C_{20}$ fatty acid, $C_{22}$ fatty acid, $C_{24}$ fatty acid, $C_{26}$ fatty acid, $C_{28}$ fatty acid, or a $C_{30}$ fatty acid. In some embodiments, the acyl group is a $C_8$ to $C_{20}$ fatty acid, e.g., a $C_{14}$ fatty acid or a $C_{16}$ fatty acid.

In an alternative embodiment, the acyl group is a bile acid. The bile acid can be any suitable bile acid, including, but not limited to, cholic acid, chenodeoxycholic acid, deoxycholic acid, lithocholic acid, taurocholic acid, glycocholic acid, and cholesterol acid.

Alkylation

In some embodiments, the incretin-insulin conjugate is modified to comprise an alkyl group. The alkyl group can be covalently linked directly to an amino acid of the insulin peptide or the incretin peptide, or indirectly to an amino acid of the incretin-insulin conjugate via a spacer, wherein the spacer is positioned between the amino acid of the incretin-insulin conjugate and the alkyl group. The alkyl group can be attached to the incretin-insulin conjugate via an ether, thioether, or amino linkage. For example, the incretin-insulin conjugate may be alkylated at the same amino acid position where a hydrophilic moiety is linked, or at a different amino acid position.

Alkylation can be carried out at any position within the incretin-insulin conjugate, including for example at position 10, 16, 30 or 40 of the incretin peptide or in the C-terminal region of the B chain or at a position in the linking moiety, provided that insulin activity is retained. In a specific aspect of the invention, the incretin-insulin conjugate is modified to comprise an alkyl group by direct alkylation of an amine, hydroxyl, or thiol of a side chain of an amino acid of the incretin-insulin conjugate. In some embodiments, the incretin-insulin conjugate is directly alkylated through the side chain amine, hydroxyl, or thiol of an amino acid. In some specific embodiments of the invention, the direct alkylation of the incretin-insulin conjugate occurs through the side chain amine, hydroxyl, or thiol of the amino acid at position A14, A15, B1 (for insulin based B chains), B2 (for IGF-1 based B chains), B10, B22, B28 or B29 (according to the amino acid numbering of the A and B chain of native insulin). Nonlimiting examples include alkylation at positions A14 and A15 of the A chain, or positions B1, B10, B22, B28 or B29 of the B chain or at any position of the linking moiety. Additional nonlimiting examples include alkylation at positions 10, 16, and 20, as well as 30 or 40 for C-terminal extended incretin peptides.

In some embodiments of the invention, the incretin-insulin conjugate comprises a spacer between the peptide and the alkyl group. In some embodiments, the incretin-insulin conjugate is covalently bound to the spacer, which is covalently bound to the alkyl group. In some exemplary embodiments, the incretin-insulin conjugate is modified to comprise an alkyl group by alkylation of an amine, hydroxyl, or thiol of the conjugate, wherein the spacer is attached to a side chain of an amino acid at position A14, A15, B1 (for insulin based B chains), B2 (for IGF-1 based B chains), B10, B22, B28 or B29 (according to the amino acid numbering of the A and B chains of native insulin) or at position 10, 16, 30 or 40 of the incretin peptide. The amino acid of the incretin-insulin conjugate to which the spacer is attached can be any amino acid (e.g., a singly α-substituted amino acid or an α,α-disubstituted amino acid) comprising a moiety which permits linkage to the spacer. An amino acid of the incretin-insulin conjugate comprising a side chain —$NH_2$, —OH, or —COOH (e.g., Lys, Orn, Ser, Asp, or Glu) is suitable. In some embodiments, the spacer between the peptide the incretin-insulin conjugate and the alkyl group is an amino acid comprising a side chain amine, hydroxyl, or thiol or a dipeptide or tripeptide comprising an amino acid comprising a side chain amine, hydroxyl, or thiol.

In the instance in which the alpha amine is alkylated, the spacer amino acid can be any amino acid. For example, the spacer amino acid can be a hydrophobic amino acid, e.g., Gly, Ala, Val, Leu, Ile, Trp, Met, Phe, Tyr. Alternatively, the spacer amino acid can be an acidic residue, e.g., Asp and Glu. In exemplary embodiments, the spacer amino acid can be a hydrophobic amino acid, e.g., Gly, Ala, Val, Leu, Ile, Trp, Met, Phe, Tyr, 6-amino hexanoic acid, 5-aminovaleric acid, 7-aminoheptanoic acid, 8-aminooctanoic acid. Alternatively, the spacer amino acid can be an acidic residue, e.g., Asp and Glu, provided that the alkylation occurs on the alpha amine of the acidic residue. In the instance in which the side chain amine of the spacer amino acid is alkylated, the spacer amino acid is an amino acid comprising a side chain amine, e.g., an amino acid of Formula Ia (e.g., Lys or Orn). In this instance, it is possible for both the alpha amine and the side chain amine of the spacer amino acid to be alkylated, such that the peptide is dialkylated. Embodiments of the invention include such dialkylated molecules.

In some embodiments, the spacer comprises a hydrophilic bifunctional spacer. In a specific embodiment, the spacer comprises an amino poly(alkyloxy)carboxylate. In this regard, the spacer can comprise, for example, $NH_2(CH_2CH_2O)_n(CH_2)_mCOOH$, wherein m is any integer from 1 to 6 and n is any integer from 2 to 12, such as, e.g., 8-amino-3,6-dioxaoctanoic acid, which is commercially available from Peptides International, Inc. (Louisville, Ky.). In some embodiments, the spacer between peptide the incretin-insulin conjugate and the alkyl group is a hydrophilic bifunctional spacer. In certain embodiments, the hydrophilic bifunctional spacer comprises two or more reactive groups, e.g., an amine, a hydroxyl, a thiol, and a carboxyl group or any combinations thereof. In certain embodiments, the hydrophilic bifunctional spacer comprises a hydroxyl group and a carboxylate. In other embodiments, the hydrophilic bifunctional spacer comprises an amine group and a carboxylate. In other embodiments, the hydrophilic bifunctional spacer comprises a thiol group and a carboxylate.

The spacer (e.g., amino acid, dipeptide, tripeptide, hydrophilic bifunctional spacer, or hydrophobic bifunctional spacer) is 3 to 10 atoms (e.g., 6 to 10 atoms, (e.g., 6, 7, 8, 9, or 10 atoms)) in length. In more specific embodiments, the spacer is about 3 to 10 atoms (e.g., 6 to 10 atoms) in length and the alkyl is a $C_{12}$ to $C_{18}$ alkyl group, e.g., $C_{14}$ alkyl group, $C_{16}$ alkyl group, such that the total length of the spacer and alkyl group is 14 to 28 atoms, e.g., about 14, 15, 16, 17, 18, 19, 20, 21, 22, 23, 24, 25, 26, 27, or 28 atoms. In some embodiments the length of the spacer and alkyl is 17 to 28 (e.g., 19 to 26, 19 to 21) atoms.

In accordance with one embodiment the bifunctional spacer is a synthetic or non-naturally occurring amino acid comprising an amino acid backbone that is 3 to 10 atoms in length (e.g., 6-amino hexanoic acid, 5-aminovaleric acid, 7-aminoheptanoic acid, and 8-aminooctanoic acid). Alternatively, the spacer can be a dipeptide or tripeptide spacer having a peptide backbone that is 3 to 10 atoms (e.g., 6 to 10 atoms) in length. The dipeptide or tripeptide spacer attached to the incretin-insulin conjugate can be composed of naturally-occurring and/or non-naturally occurring amino acids, including, for example, any of the amino acids taught herein. In some embodiments the spacer comprises an overall negative charge, e.g., comprises one or two negatively charged amino acids. In some embodiments the dipeptide spacer is selected from the group consisting of: Ala-Ala, β-Ala-β-Ala, Leu-Leu, Pro-Pro, γ-aminobutyric acid-γ-aminobutyric acid, and γ-Glu-γ-Glu. In one embodiment the dipeptide spacer is γ-Glu-γ-Glu.

Suitable methods of peptide alkylation via amines, hydroxyls, and thiols are known in the art. For example, a Williamson ether synthesis can be used to form an ether linkage between the insulin peptide and the alkyl group. Also, a nucleophilic substitution reaction of the peptide with an alkyl halide can result in any of an ether, thioether, or amino linkage. The alkyl group of the alkylated peptide the incretin-insulin conjugate can be of any size, e.g., any length carbon chain, and can be linear or branched. In some embodiments of the invention, the alkyl group is a $C_4$ to $C_{30}$ alkyl. For example, the alkyl group can be any of a $C_4$ alkyl, $C_6$ alkyl, $C_8$ alkyl, $C_{10}$ alkyl, $C_{12}$ alkyl, $C_{14}$ alkyl, $C_{16}$ alkyl, $C_{18}$ alkyl, $C_{20}$ alkyl, $C_{22}$ alkyl, $C_{24}$ alkyl, $C_{26}$ alkyl, $C_{28}$ alkyl, or a $C_{30}$ alkyl. In some embodiments, the alkyl group is a $C_8$ to $C_{20}$ alkyl, e.g., a $C_{14}$ alkyl or a $C_{16}$ alkyl.

In some specific embodiments, the alkyl group comprises a steroid moiety of a bile acid, e.g., cholic acid, chenodeoxycholic acid, deoxycholic acid, lithocholic acid, taurocholic acid, glycocholic acid, and cholesterol acid.

When a long chain alkane is alkylated by the incretin-insulin conjugate or the spacer, the long chain alkane may be of any size and can comprise any length of carbon chain. The long chain alkane can be linear or branched. In certain aspects, the long chain alkane is a $C_4$ to $C_{30}$ alkane. For example, the long chain alkane can be any of a $C_4$ alkane, $C_6$ alkane, $C_8$ alkane, $C_{10}$ alkane, $C_{12}$ alkane, $C_{14}$ alkane, $C_{16}$ alkane, $C_{18}$ alkane, $C_{20}$ alkane, $C_{22}$ alkane, $C_{24}$ alkane, $C_{26}$ alkane, $C_{28}$ alkane, or a $C_{30}$ alkane. In some embodiments the long chain alkane comprises a $C_8$ to $C_{20}$ alkane, e.g., a $C_{14}$ alkane, $C_{16}$ alkane, or a $C_{18}$ alkane.

Also, in some embodiments alkylation can occur between the insulin analog and a cholesterol moiety. For example, the hydroxyl group of cholesterol can displace a leaving group on the long chain alkane to form a cholesterol-insulin peptide product.

Controlled Release Formulations

Alternatively, the incretin-insulin conjugates described herein can be modified into a depot form, such that the manner in which the conjugate of the present disclosure is released into the body to which it is administered is controlled with respect to time and location within the body (see, for example, U.S. Pat. No. 4,450,150). Depot forms of the conjugates of the present disclosure can be, for example, an implantable composition comprising the conjugate of the present disclosure and a porous or non-porous material, such as a polymer, wherein the conjugate of the present disclosure is encapsulated by or diffused throughout the material and/or degradation of the non-porous material. The depot is then implanted into the desired location within the body and the conjugate of the present disclosure are released from the implant at a predetermined rate.

Alternatively, a large depot polymer can be linked to a self-cleaving dipeptide element that is covalently bound to the conjugate as described herein. In this embodiment, the depot polymer effectively sequesters the incretin-insulin conjugate at its site of administration until it is subsequently cleaved from the single chain analog via a non-enzymatic reaction at a predetermined rate. Depot formulations of insulin analogs using a self-cleaving dipeptide have been described in published international application no. WO 2010/080607, the disclosure of which is incorporated herein. In one embodiment a incretin-insulin conjugate is provided comprising a dipeptide prodrug element wherein the dipeptide prodrug element is linked to a large polymer such as PEG or dextran. In one embodiment a self-cleaving dipeptide element comprising a large depot polymer (including for example, PEG) is linked to the side chain of an amino acid of the linking moiety, including for example, the amino acid at position C8 of the linking moiety.

Pharmaceutical compositions can be prepared that comprise the single chain analogs and are formulated to have a desired in vivo release profile. In some aspects, the pharmaceutical composition is an immediate release, controlled release, sustained release, extended release, delayed release, or bi-phasic release formulation. Methods of formulating peptides or conjugates for controlled release are known in the art. See, for example, J Pharm 374: 46-52 (2009) and International Patent Application Publication Nos. WO 2008/130158, WO2004/033036; WO2000/032218; and WO 1999/040942. The instant compositions may further comprise, for example, micelles or liposomes, or some other encapsulated form, or may be administered in an extended release form to provide a prolonged storage and/or delivery effect. The disclosed pharmaceutical formulations may be administered according to any regime including, for example, daily (1 time per day, 2 times per day, 3 times per day, 4 times per day, 5 times per day, 6 times per day), every two days, every three days, every four days, every five days, every six days, weekly, bi-weekly, every three weeks, monthly, or bi-monthly.

In accordance with one embodiment the depot polymer is selected from biocompatible polymers known to those skilled in the art. The depot polymers typically have a size selected from a range of about 20,000 to 120,000 Daltons. In one embodiment the depot polymer has a size selected from a range of about 40,000 to 100,000 or about 40,000 to 80,000 Daltons. In one embodiment the depot polymer has a size of about 40,000, 50,000, 60,000, 70,000 or 80,000 Daltons. Suitable depot polymers include but are not limited to dextrans, polylactides, polyglycolides, caprolactone-based polymers, poly(caprolactone), polyanhydrides, polyamines, polyesteramides, polyorthoesters, polydioxanones, polyacetals, polyketals, polycarbonates, polyphosphoesters, polyesters, polybutylene terephthalate, polyorthocarbonates, polyphosphazenes, succinates, poly(malic acid), poly(amino acids), polyvinylpyrrolidone, polyethylene glycol, polyhydroxycellulose, polysaccharides, chitin, chitosan, hyaluronic acid, and copolymers, terpolymers and mixtures thereof, and biodegradable polymers and their copolymers including caprolactone-based polymers, polycaprolactones and copolymers which include polybutylene terephthalate. In one embodiment the depot polymer is selected from the group consisting of polyethylene glycol, dextran, polylactic acid, polyglycolic acid and a copolymer of lactic acid and glycolic acid, and in one specific embodiment the depot polymer is polyethylene glycol. In one embodiment the depot polymer is polyethylene glycol and the combined molecular weight of depot polymer(s) linked to the dipeptide element is about 40,000 to 80,000 Daltons.

In accordance with one embodiment a self-cleaving dipeptide element is provided, comprising the structure U-J, wherein U is an amino acid or a hydroxyl acid and J is an N-alkylated amino acid. In one embodiment one or more dipeptide elements are linked to the incretin-insulin conjugate through an amide bond formed through one or more amino groups selected from the N-terminal amino group of the B chain of the insulin component, the N-terminus of the incretin peptide component, or the side chain amino group of an amino acid present in the conjugate. In accordance with one embodiment one or more dipeptide elements are linked to the incretin-insulin conjugate at an amino group selected from the N-terminal amino group of the conjugate, or the side chain amino group of an aromatic amine of a 4-amino-phenylalanine residue present at a position corresponding to position A19, B16 or B25 of native insulin, or a side chain of an amino acid of the linking moiety of a single chain insulin analog, or the N-terminus of the incretin peptide or insulin peptide components of the conjugate.

In one embodiment the dipeptide prodrug element comprises the general structure of Formula X:

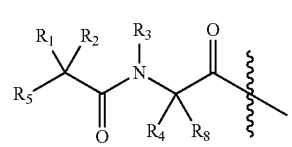

X wherein
$R_1$, $R_2$, $R_4$ and $R_8$ are independently selected from the group consisting of H, $C_1$-$C_{18}$ alkyl, $C_2$-$C_{18}$ alkenyl, ($C_1$-$C_{18}$ alkyl)OH, ($C_1$-$C_{18}$ alkyl)SH, ($C_2$-$C_3$ alkyl)SCH$_3$, ($C_1$-$C_4$ alkyl)CONH$_2$, ($C_1$-$C_4$ alkyl)COOH, ($C_1$-$C_4$ alkyl)NH$_2$, ($C_1$-$C_4$ alkyl)NHC(NH$_2^+$)NH$_2$, ($C_0$-$C_4$ alkyl)($C_3$-$C_6$ cycloalkyl), ($C_0$-$C_4$ alkyl)($C_2$-$C_5$ heterocyclic), ($C_0$-$C_4$ alkyl)($C_6$-$C_{10}$ aryl)$R_7$, ($C_1$-$C_4$ alkyl)($C_3$-$C_9$ heteroaryl), and $C_1$-$C_{12}$ alkyl (W)$C_1$-$C_{12}$ alkyl, wherein W is a heteroatom selected from the group consisting of N, S and O, or $R_1$ and $R_2$ together with the atoms to which they are attached form a $C_3$-$C_{12}$ cycloalkyl or aryl; or $R_4$ and $R_8$ together with the atoms to which they are attached form a $C_3$-$C_6$ cycloalkyl;

$R_3$ is selected from the group consisting of $C_1$-$C_{18}$ alkyl, ($C_1$-$C_{18}$ alkyl)OH, ($C_1$-$C_{18}$ alkyl)NH$_2$, ($C_1$-$C_{18}$ alkyl)SH, ($C_0$-$C_4$ alkyl)($C_3$-$C_6$)cycloalkyl, ($C_0$-$C_4$ alkyl)($C_2$-$C_5$ heterocyclic), ($C_0$-$C_4$ alkyl)($C_6$-$C_{10}$ aryl)$R_7$, and ($C_1$-$C_4$ alkyl)($C_3$-$C_9$ heteroaryl) or $R_4$ and $R_3$ together with the atoms to which they are attached form a 4, 5 or 6 member heterocyclic ring;

$R_5$ is NHR$_6$ or OH;

$R_6$ is H, $C_1$-$C_8$ alkyl or $R_6$ and $R_2$ together with the atoms to which they are attached form a 4, 5 or 6 member heterocyclic ring; and $R_7$ is selected from the group consisting of H and OH. In one embodiment when the prodrug element is linked to the N-terminal amine of the incretin-insulin conjugate and $R_4$ and $R_3$ together with the atoms to which they are attached form a 4, 5 or 6 member heterocyclic ring, then at least one of $R_1$ and $R_2$ are other than H.

In accordance with one embodiment an increlin/insulin conjugate prodrug is provided comprising the structure: A-B-C-Q;

wherein Q is an increlin/insulin conjugate as disclosed herein;

A is an amino acid or hydroxyl acid comprising a side chain, optionally ($C_1$-$C_8$ alkyl)NH$_2$, wherein the side chain of A is covalently linked to a moiety that irreversibly binds a mammalian plasma protein, including for example, mammalian serum albumin. In one embodiment the side chain of A is covalently linked to an acyl or alkyl group, including a fatty acid, cholic acid, bile salts or steroid moiety of a bile acid, that is preferably at least 18, 19, 20, 21 or 22 carbons in length. In one embodiment the side chain of A is covalently linked to a $C_{16}$-$C_{30}$ acyl group or a $C_{16}$-$C_{30}$ alkyl group;

B is an N-alkylated amino acid; and

C is an amide bond, $X_{70}$ or $X_{70}X_{71}$, wherein $X_{70}$ and $X_{71}$ are amino acids independently selected from the group consisting of glycine, aspartic acid, glutamic acid, cysteic acid, homocysteic acid, homoglutamic acid, arginine, lysine and histidine, wherein A-B-C is linked to Q through an amide bond via an aliphatic amino group of Q.

Optionally, the linkage between the side chain of A and the acyl or alkyl group is via a spacer, wherein the spacer comprises one or two charged amino acids. In accordance with one embodiment the structure A-B-C is linked to Q through an amide bond linkage at an aliphatic amino group selected from the alpha amino group on the N-terminal amino acid of the incretin peptide, the A chain or the B chain, or an aliphatic amino group on a side chain of an B3, B28 or B29 amino acid of the insulin peptide. In accordance with one embodiment B is an amino acid N-alkylated with $C_1$-$C_{18}$ alkyl, $C_3$-$C_{18}$ alkenyl, ($C_0$-$C_4$ alkyl)($C_4$-$C_6$ cycloalkyl), ($C_0$-$C_4$ alkyl)($C_3$-$C_5$ heterocyclic), or ($C_0$-$C_4$ alkyl)($C_6$-$C_{10}$ aryl).

In another embodiment A-B-C comprises a structure of:

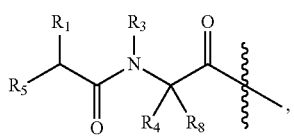

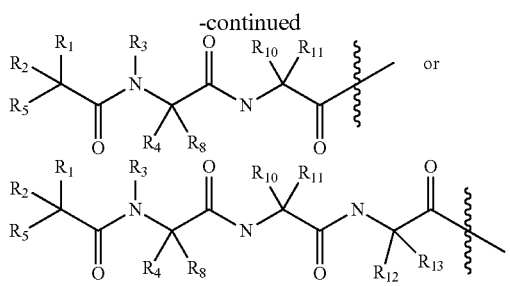

wherein $R_1$ is ($C_1$-$C_6$ alkyl)NH—$R_9$ or ($C_1$-$C_6$ alkyl)NH—$S_1$—$R_9$;

$R_2$ is H or $C_1$-$C_6$ alkyl;

$R_3$ is selected from the group consisting of $C_2$-$C_4$ alkyl, $C_3$-$C_8$ alkenyl, ($C_0$-$C_4$ alkyl)($C_4$-$C_6$ cycloalkyl), ($C_0$-$C_4$ alkyl)($C_3$-$C_5$ heterocyclic), ($C_0$-$C_4$ alkyl)($C_6$-$C_{10}$ aryl) and ($C_1$-$C_4$ alkyl)($C_6$-$C_{10}$ heteroaryl), or $R_4$ and $R_3$ together with the atoms to which they are attached form a 4, 5 or 6 member heterocyclic ring;

$R_4$, and $R_8$ are independently selected from the group consisting of H, $C_1$-$C_{18}$ alkyl, $C_2$-$C_{18}$ alkenyl, ($C_1$-$C_{18}$ alkyl)OH, ($C_1$-$C_{18}$ alkyl)SH, ($C_2$-$C_3$ alkyl)SCH$_3$, ($C_1$-$C_4$ alkyl)CONH$_2$, ($C_1$-$C_4$ alkyl)COOH, ($C_1$-$C_4$ alkyl)NH$_2$, ($C_1$-$C_4$ alkyl)NHC(NH$_2^+$)NH$_2$, ($C_0$-$C_4$ alkyl)($C_3$-$C_6$ cycloalkyl), ($C_0$-$C_4$ alkyl)($C_2$-$C_5$ heterocyclic), ($C_0$-$C_4$ alkyl)($C_6$-$C_{10}$ aryl)$R_7$, ($C_1$-$C_4$ alkyl)($C_3$-$C_9$ heteroaryl), and $C_1$-$C_{12}$ alkyl($W_1$)$C_1$-$C_{12}$ alkyl, wherein $W_1$ is a heteroatom selected from the group consisting of N, S and O, or $R_4$ and $R_8$ together with the atoms to which they are attached form a $C_3$-$C_6$ cycloalkyl;

$R_5$ is NHR$_6$ or OH;

$R_6$ is H, or $C_1$-$C_8$ alkyl;

$R_7$ is selected from the group consisting of H, OH, $C_1$-$C_{18}$ alkyl, $C_2$-$C_{18}$ alkenyl, ($C_0$-$C_4$ alkyl)NH$_2$, and ($C_0$-$C_4$ alkyl)OH;

$R_9$ is selected from the group consisting of $C_{18}$-$C_{30}$ acyl;

$R_{10}$, $R_{11}$, $R_{12}$, and $R_{13}$ are independently selected from the group consisting of H, CH$_2$, CHOH, CH$_2$SH, ($C_1$-$C_4$ alkyl)COOH, ($C_1$-$C_4$ alkyl)NH$_2$, ($C_1$-$C_4$ alkyl)NHC(NH$_2^+$)NH$_2$ and CH$_2$($C_3$—N$_2$ heterocyclic); and $S_1$ is a spacer consisting of one or two charged amino acids selected from the group consisting of aspartic acid, glutamic acid, cysteic acid, homocysteic acid, homoglutamic acid, arginine, lysine and histidine, wherein A-B-C is linked to Q through an amide bond via an aliphatic amino group of Q. In one embodiment $R_1$ is ($C_1$-$C_6$ alkyl)NH—$S_1$—$R_9$; $R_3$ is selected from the group consisting of $C_2$-$C_4$ alkyl; $R_2$, $R_4$, $R_{11}$, and $R_{13}$ are each H; $R_5$ is NH$_2$; $R_8$ is H or $C_1$-$C_8$ alkyl; $R_9$ is $C_{18}$-$C_{30}$ acyl; $R_{10}$ and $R_{12}$ are independently selected from the group consisting of ($C_1$-$C_4$ alkyl)COOH, ($C_1$-$C_4$ alkyl)NH$_2$ and ($C_1$-$C_4$ alkyl)NHC(NH$_2^+$)NH$_2$; and $S_1$ is a spacer comprising one or two charged amino acids selected from the group consisting of aspartic acid, glutamic acid, cysteic acid, homocysteic acid, homoglutamic acid, arginine, lysine and histidine.

In a further embodiment the peptide prodrug element A-B-C as disclosed in the immediate above paragraphs are further modified to prevent cleavage of the peptide prodrug element during storage and prior to administration to a patient. In one embodiment the N-terminal amine of the peptide prodrug element is linked to a moiety that remains bound to the N-terminus until administration to the patient. In one embodiment, the insulin prodrug of the formula A-B-C-Q further comprises a serum enzyme cleavable moiety linked to A via the N-terminal amine of A. In one embodiment the enzyme cleavable moiety is a peptide that is cleaved by dipeptidyl peptidase IV (DPP-IV), including for example a dipeptide of Arg-Pro, Lys-Pro or Glu-Pro.

Glucagon Related Peptides

Applicants have discovered analogs of glucagon that have altered activities at the glucagon, GLP1 and GIP receptors. Any of these analogs (referred to generally as incretins) can be used as the glucagon related peptide in the conjugates described herein. More particularly the glucagon related peptide can be any of the class 1, class 2 or class 3 glucagon peptides described herein.

Class 1 Glucagon Related Peptides

In certain embodiments, the glucagon related peptide is a Class 1 glucagon related peptide, which is described herein and in International Patent Application No. PCT US2009/47437 (filed on Jun. 16, 2009) and International Patent Application Publication No. WO 2008/086086, published on Jul. 17, 2008, the contents of which are incorporated by reference in their entirety.

The biological sequences referenced in the following section (SEQ ID NOs: 801-915) relating to Class 1 glucagon related peptides correspond to SEQ ID NOs: 1-115 in International Patent Application No. PCT US2009/47437.

Activity

Class 1 glucagon related peptides retain glucagon receptor activity relative to the native glucagon peptide (SEQ ID NO: 801). For example, the glucagon related peptide can retain at least 10%, 20%, 30%, 40%, 50%, 60%, 70%, 75% activity, 80% activity, 85% activity, or 90% of the activity of native glucagon (calculated as the inverse ratio of EC50s for the glucagon related peptide vs. glucagon, e.g., as measured by cAMP production using the assay generally described in Example 7). In some embodiments, the Class 1 glucagon related peptides have the same or greater activity (used synonymously with the term "potency" herein) than glucagon. In some embodiments, the glucagon related peptides described herein exhibit no more than about 100%, 1000%, 10,000%, 100,000%, or 1,000,000% of the activity of native glucagon peptide.

Improved Solubility

Native glucagon exhibits poor solubility in aqueous solution, particularly at physiological pH, with a tendency to aggregate and precipitate over time. In contrast, the Class 1 glucagon related peptides in some embodiments exhibit at least 2-fold, 5-fold, or even higher solubility compared to native glucagon at a pH between 6 and 8, or between 6 and 9, for example, at pH 7 after 24 hours at 25° C.

Accordingly, in some embodiments, a Class 1 glucagon related peptide has been modified relative to the wild type peptide of His-Ser-Gln-Gly-Thr-Phe-Thr-Ser-Asp-Tyr-Ser-Lys-Tyr-Leu-Asp-Ser-Arg-Arg-Ala-Gln-Asp-Phe-Val-Gln-Trp-Leu-Met-Asn-Thr (SEQ ID NO: 801) to improve the peptide's solubility in aqueous solutions, particularly at a pH ranging from about 5.5 to about 8.0, while retaining the native peptide's biological activity.

For example, the solubility of any of the Class 1 glucagon related peptides described herein can be further improved by attaching a hydrophilic moiety to the peptide. Introduction of such groups also increases duration of action, e.g. as measured by a prolonged half-life in circulation. Hydrophilic moieties are further described herein.

Modification with Charged Residues

In some embodiments, solubility is improved by adding charge to the Class 1 glucagon related peptide by the substitution of native non-charged amino acids with charged amino acids selected from the group consisting of lysine, arginine, histidine, aspartic acid and glutamic acid, or by the addition of charged amino acids to the amino or carboxy terminus of the peptide.

In accordance with some embodiments, the Class 1 glucagon related peptide has improved solubility due to the fact that the peptide is modified by amino acid substitutions and/or additions that introduce a charged amino acid into the C-terminal portion of the peptide, and in some embodiments at a position C-terminal to position 27 of SEQ ID NO: 801. Optionally, one, two or three charged amino acids may be introduced within the C-terminal portion, and in some embodiments C-terminal to position 27. In accordance with some embodiments, the native amino acid(s) at positions 28 and/or 29 are substituted with a charged amino acid, and/or one to three charged amino acids are added to the C-terminus of the peptide, e.g. after position 27, 28 or 29. In exemplary embodiments, one, two, three or all of the charged amino acids are negatively charged. In other embodiments, one, two, three or all of the charged amino acids are positively charged.

In specific exemplary embodiments, the Class 1 glucagon related peptide may comprise any one or two of the following modifications: substitution of N28 with E; substitution of N28 with D; substitution of T29 with D; substitution of T29 with E; insertion of E after position 27, 28 or 29; insertion of D after position 27, 28 or 29. For example, D28E29, E28E29, E29E30, E28E30, D28E30.

In accordance with one exemplary embodiment, the Class 1 glucagon related peptide comprises an amino acid sequence of SEQ ID NO: 811, or an analog thereof that contains 1 to 3 further amino acid modifications (described herein in reference to glucagon agonists) relative to native glucagon, or a glucagon agonist analog thereof. SEQ ID NO: 811 represents a modified Class 1 glucagon related peptide, wherein the asparagine residue at position 28 of the native protein has been substituted with an aspartic acid. In another exemplary embodiment the Class 1 glucagon related peptide comprises an amino acid sequence of SEQ ID NO: 838, wherein the asparagine residue at position 28 of the native protein has been substituted with glutamic acid. Other exemplary embodiments include Class 1 glucagon related peptides of SEQ ID NOS: 824, 825, 826, 833, 835, 836 and 837.

Improved Stability

Any of the Class 1 glucagon related peptides may additionally exhibit improved stability and/or reduced degradation, for example, retaining at least 95% of the original peptide after 24 hours at 25° C. The Class 1 glucagon related peptides may include additional modifications that alter its pharmaceutical properties, e.g. increased potency, prolonged half-life in circulation, increased shelf-life, reduced precipitation or aggregation, and/or reduced degradation, e.g., reduced occurrence of cleavage or chemical modification after storage.

In yet further exemplary embodiments, any of the foregoing Class 1 glucagon related peptides can be further modified to improve stability by modifying the amino acid at position 15 of SEQ ID NO: 801 to reduce degradation of the peptide over time, especially in acidic or alkaline buffers. In exemplary embodiments, Asp at position 15 is substituted with a Glu, homo-Glu, cysteic acid, or homo-cysteic acid.

Alternatively, any of the Class 1 glucagon related peptides described herein can be further modified to improve stability by modifying the amino acid at position 16 of SEQ ID NO: 801. In exemplary embodiments, Ser at position 16 is substituted with Thr or AIB, or any of the amino acids substitutions described herein with regard to Class 1 glucagon related peptides which enhance potency at the glucagon receptor. Such modifications reduce cleavage of the peptide bond between Asp15-Ser16.

In some embodiments, any of the Class 1 glucagon related peptides described herein can be further modified to reduce degradation at various amino acid positions by modifying any one, two, three, or all four of positions 20, 21, 24, or 27. Exemplary embodiments include substitution of Gln at position 20 with Ser, Thr, Ala or AIB, substitution of Asp at position 21 with Glu, substitution of Gln at position 24 with Ala or AIB, substitution of Met at position 27 with Leu or Nle. Removal or substitution of methionine reduces degradation due to oxidation of the methionine. Removal or substitution of Gln or Asn reduces degradation due to deamidation of Gln or Asn. Removal or substitution of Asp reduces degradation that occurs through dehydration of Asp to form a cyclic succinimide intermediate followed by isomerization to iso-aspartate.

Enhanced Potency

In accordance with another embodiment, Class 1 glucagon related peptides are provided that have enhanced potency at the glucagon receptor, wherein the peptides comprise an amino acid modification at position 16 of native glucagon (SEQ ID NO: 801). By way of nonlimiting example, such enhanced potency can be provided by substituting the naturally occurring serine at position 16 with glutamic acid or with another negatively charged amino acid having a side chain with a length of 4 atoms, or alternatively with any one of glutamine, homoglutamic acid, or homocysteic acid, or a charged amino acid having a side chain containing at least one heteroatom, (e.g. N, O, S, P) and with a side chain length of about 4 (or 3-5) atoms. Substitution of serine at position 16 with glutamic acid enhances glucagon activity at least 2-fold, 4-fold, 5-fold and up to 10-fold greater at the glucagon receptor. In some embodiments, the Class 1 glucagon related peptide retains selectivity for the glucagon receptor relative to the GLP-1 receptors, e.g., at least 5-fold, 10-fold, or 15-fold selectivity.

DPP-IV Resistance

In some embodiments, the Class 1 glucagon related peptides disclosed herein are further modified at position 1 or 2 to reduce susceptibility to cleavage by dipeptidyl peptidase IV. More particularly, in some embodiments, position 1 and/or position 2 of the Class 1 glucagon related peptide is substituted with the DPP-IV resistant amino acid(s) described herein. In some embodiments, position 2 of the analog peptide is substituted with an aminoisobutyric acid. In some embodiments, position 2 of the analog peptide is substituted with an amino acid selected from the group consisting of D-serine, D-alanine, glycine, N-methyl serine, and ε-amino butyric acid. In another embodiment, position 2 of the Class 1 glucagon related peptide is substituted with an amino acid selected from the group consisting of D-serine, glycine, and aminoisobutyric acid. In some embodiments, the amino acid at position 2 is not D-serine.

Reduction in glucagon activity upon modification of the amino acids at position 1 and/or position 2 of the glucagon related peptide can be restored by stabilization of the alpha-helix structure in the C-terminal portion of the glucagon related peptide (around amino acids 12-29). The alpha helix structure can be stabilized by, e.g., formation of a covalent or non-covalent intramolecular bridge (e.g., a lactam bridge between side chains of amino acids at positions "i" and "i+4", wherein i is an integer from 12 to 25), substitution and/or insertion of amino acids around positions 12-29 with an alpha helix-stabilizing amino acid (e.g., an α,α-disubstituted amino acid), as further described herein.

Modifications at Position 3

Glucagon receptor activity can be reduced by an amino acid modification at position 3 (according to the amino acid numbering of wild type glucagon), e.g. substitution of the naturally occurring glutamine at position 3, with an acidic, basic, or a hydrophobic amino acid. For example substitution at position 3 with glutamic acid, ornithine, or norleucine substantially reduces or destroys glucagon receptor activity.

Maintained or enhanced activity at the glucagon receptor may be achieved by modifying the Gln at position 3 with a glutamine analog as described herein. For example, glucagon agonists can comprise the amino acid sequence of SEQ ID NO: 863, SEQ ID NO: 869, SEQ ID NO: 870, SEQ ID NO: 871, SEQ ID NO: 872, SEQ ID NO: 873 and SEQ ID NO: 874.

Enhancing GLP-1 Activity with C-terminal Amides and Esters

Enhanced activity at the GLP-1 receptor is provided by replacing the carboxylic acid of the C-terminal amino acid with a charge-neutral group, such as an amide or ester. Conversely, retaining the native carboxylic acid at the C-terminus of the peptide maintains the relatively greater selectivity of the Class 1 glucagon related peptide for the glucagon receptor vs. the GLP-1 receptor (e.g., greater than about 5, 6, 7, 8, 9, 10, 11, 12, 13, 14, 15, 16, 17, 18, 19, or 20-fold).

Further Modifications and Combinations

Additional modifications may be made to the Class 1 glucagon related peptide which may further increase solubility and/or stability and/or glucagon activity. The Class 1 glucagon related peptide may alternatively comprise other modifications that do not substantially affect solubility or stability, and that do not substantially decrease glucagon activity. In exemplary embodiments, the Class 1 glucagon related peptide may comprise a total of up to 11, or up to 12, or up to 13, or up to 14 amino acid modifications relative to the native glucagon sequence. For example, conservative or non-conservative substitutions, additions or deletions may be carried out at any of positions 2, 5, 7, 10, 11, 12, 13, 14, 17, 18, 19, 20, 21, 24, 27, 28 or 29.

Exemplary Modifications of the Class 1 Glucagon Related Peptide Include but are not Limited to:

(a) non-conservative substitutions, conservative substitutions, additions or deletions while retaining at least partial glucagon agonist activity, for example, conservative substitutions at one or more of positions 2, 5, 7, 10, 11, 12, 13, 14, 16, 17, 18, 19, 20, 21, 24, 27, 28 or 29, substitution of Tyr at position 10 with Val or Phe, substitution of Lys at position 12 with Arg, substitution of one or more of these positions with Ala;

(b) deletion of amino acids at positions 29 and/or 28, and optionally position 27, while retaining at least partial glucagon agonist activity;

(c) modification of the aspartic acid at position 15, for example, by substitution with glutamic acid, homoglutamic acid, cysteic acid or homocysteic acid, which may reduce degradation; or modification of the serine at position 16, for example, by substitution of threonine, AIB, glutamic acid or with another negatively charged amino acid having a side chain with a length of 4 atoms, or alternatively with any one of glutamine, homoglutamic acid, or homocysteic acid, which likewise may reduce degradation due to cleavage of the Asp15-Ser16 bond;

(d) addition of a hydrophilic moiety such as the water soluble polymer polyethylene glycol, as described herein, e.g. at position 16, 17, 20, 21, 24, 29, 40 or at the C-terminal amino acid, which may increase solubility and/or half-life;

(e) modification of the methionine at position 27, for example, by substitution with leucine or norleucine, to reduce oxidative degradation;

(f) modification of the Gln at position 20 or 24, e.g. by substitution with Ser, Thr, Ala or AIB, to reduce degradation that occurs through deamidation of Gln (g) modification of Asp at position 21, e.g. by substitution with Glu, to reduce degradation that occurs through dehydration of Asp to form a cyclic succinimide intermediate followed by isomerization to iso-aspartate;

(h) modifications at position 1 or 2 as described herein that improve resistance to DPP-IV cleavage, optionally in combination with an intramolecular bridge such as a lactam bridge between positions "i" and "i+4", wherein i is an integer from 12 to 25, e.g., 12, 16, 20, 24;

(i) acylating or alkylating the glucagon related peptide as described herein, which may increase the activity at the glucagon receptor and/or the GLP-1 receptor, increase half-life in circulation and/or extending the duration of action and/or delaying the onset of action, optionally combined with addition of a hydrophilic moiety, additionally or alternatively, optionally combined with a modification which selectively reduces activity at the GLP-1 peptide, e.g., a modification of the Thr at position 7, such as a substitution of the Thr at position 7 with an amino acid lacking a hydroxyl group, e.g., Abu or Ile; deleting amino acids C-terminal to the amino acid at position 27 (e.g., deleting one or both of the amino acids at positions 28 and 29, yielding a peptide 27 or 28 amino acids in length);

(j) C-terminal extensions as described herein;

(k) homodimerization or heterodimerization as described herein; and combinations of the (a) through (k).

In some embodiments, exemplary modifications of the Class 1 glucagon related peptide include at least one amino acid modification selected from Group A and one or more amino acid modifications selected from Group B and/or Group C, wherein Group A is:
  substitution of Asn at position 28 with a charged amino acid;
  substitution of Asn at position 28 with a charged amino acid selected from the group consisting of Lys, Arg, His, Asp, Glu, cysteic acid, and homocysteic acid;
  substitution at position 28 with Asn, Asp, or Glu;
  substitution at position 28 with Asp;
  substitution at position 28 with Glu;
  substitution of Thr at position 29 with a charged amino acid;
  substitution of Thr at position 29 with a charged amino acid selected from the group consisting of Lys, Arg, His, Asp, Glu, cysteic acid, and homocysteic acid;
  substitution at position 29 with Asp, Glu, or Lys;
  substitution at position 29 with Glu;
  insertion of 1-3 charged amino acids after position 29;
  insertion after position 29 of Glu or Lys;
  insertion after position 29 of Gly-Lys or Lys-Lys;
  or combinations thereof;
wherein Group B is:
  substitution of Asp at position 15 with Glu;
  substitution of Ser at position 16 with Thr or AIB;
and wherein Group C is:
  substitution of His at position 1 with a non-native amino acid that reduces susceptibility of the glucagon related peptide to cleavage by dipeptidyl peptidase IV (DPP-IV),
  substitution of Ser at position 2 with a non-native amino acid that reduces susceptibility of the glucagon related peptide to cleavage by dipeptidyl peptidase IV (DPP-IV),
  substitution of Lys at position 12 with Arg;
  substitution of Gln at position 20 with Ser, Thr, Ala or AIB;
  substitution of Asp at position 21 with Glu;
  substitution of Gln at position 24 with Ser, Thr, Ala or AIB;
  substitution of Met at position 27 with Leu or Nle;
  deletion of amino acids at positions 27-29;
  deletion of amino acids at positions 28-29;
  deletion of the amino acid at positions 29;
  or combinations thereof.

In exemplary embodiments, Lys at position 12 is substituted with Arg. In other exemplary embodiments amino acids at positions 29 and/or 28, and optionally at position 27, are deleted.

In some specific embodiments, the glucagon related peptide comprises (a) an amino acid modification at position 1 and/or 2 that confers DPP-IV resistance, e.g., substitution with DMIA at position 1, or AIB at position 2, (b) an intramolecular bridge within positions 12-29, e.g. at positions 16 and 20, or one or more substitutions of the amino acids at positions 16, 20, 21, and 24 with an α,α disubstituted amino acid, optionally (c) linked to a hydrophilic moiety such as PEG, e.g., through Cys at position 24, 29 or at the C-terminal amino acid, optionally (d) an amino acid modification at position 27 that substitutes Met with, e.g., Nle, optionally (e) amino acid modifications at positions 20, 21 and 24 that reduce degradation, and optionally (f) linked to SEQ ID NO: 820. When the glucagon related peptide is linked to SEQ ID NO: 820, the amino acid at position 29 in certain embodiments is Thr or Gly. In other specific embodiments, the glucagon related peptide comprises (a) Asp28Glu29, or Glu28Glu29, or Glu29Glu30, or Glu28Glu30 or Asp28Glu30, and optionally (b) an amino acid modification at position 16 that substitutes Ser with, e.g. Thr or AIB, and optionally (c) an amino acid modification at position 27 that substitutes Met with, e.g., Nle, and optionally (d) amino acid modifications at positions 20, 21 and 24 that reduce degradation. In a specific embodiment, the glucagon related peptide is T16, A20, E21, A24, Nle27, D28, E29.

In some embodiments, the Class 1 glucagon related peptide comprises the amino acid sequence: X1-X2-Gln-Gly-Thr-Phe-Thr-Ser-Asp-Tyr-Ser-Lys-Tyr-Leu-Asp-Ser-Arg-Arg-Ala-Gln-Asp-Phe-Val-Gln-Trp-Leu-Met-$Z_1$ (SEQ ID NO: 839) with 1 to 3 amino acid modifications thereto, wherein $X_1$ and/or $X_2$ is a non-native amino acid that reduces susceptibility of (or increases resistance of) the glucagon related peptide to cleavage by dipeptidyl peptidase IV (DPP-IV), wherein $Z_1$ is selected from the group consisting of —COOH (the naturally occurring C-terminal carboxylate), -Asn-COOH, Asn-Thr-COOH, and Y—COOH, wherein Y is 1 to 2 amino acids, and wherein an intramolecular bridge, preferably a covalent bond, connects the side chains of an amino acid at position i and an amino acid at position i+4, wherein i is 12, 16, 20 or 24.

In some embodiments, the intramolecular bridge is a lactam bridge. In some embodiments, the amino acids at positions i and i+4 of SEQ ID NO: 839 are Lys and Glu, e.g., Glu16 and Lys20. In some embodiments, $X_1$ is selected from the group consisting of: D-His, N-methyl-His, alpha-methyl-His, imidazole acetic acid, des-amino-His, hydroxyl-His, acetyl-His, homo-His, and alpha, alpha-dimethyl imidiazole acetic acid (DMIA). In other embodiments, $X_2$ is selected from the group consisting of: D-Ser, D-Ala, Gly, N-methyl-Ser, Val, and alpha, aminoisobutyric acid (AIB). In some embodiments, the glucagon related peptide is covalently linked to a hydrophilic moiety at any of amino acid positions 16, 17, 20, 21, 24, 29, 40, within a C-terminal extension, or at the C-terminal amino acid. In exemplary embodiments, this hydrophilic moiety is covalently linked to a Lys, Cys, Orn, homocysteine, or acetyl-phenylalanine residue at any of these positions. Exemplary hydrophilic moieties include polyethylene glycol (PEG), for example, of a molecular weight of about 1,000 Daltons to about 40,000 Daltons, or about 20,000 Daltons to about 40,000 Daltons.

In other embodiments, the Class I glucagon related peptide comprises the amino acid sequence: $X_1$-$X_2$-Gln-Gly-Thr-Phe-Thr-Ser-Asp-Tyr-Ser-Lys-Tyr-Leu-Asp-Ser-Arg-Arg-Ala-Gln-Asp-Phe-Val-Gln-Trp-Leu-Met-$Z_1$ (SEQ ID NO: 839), wherein $X_1$ and/or $X_2$ is a non-native amino acid that reduces susceptibility of (or increases resistance of) the glucagon related peptide to cleavage by dipeptidyl peptidase IV (DPP-IV), wherein one, two, three, four or more of positions 16, 20, 21, and 24 of the glucagon related peptide is substituted with an α,α-disubstituted amino acid, and wherein $Z_1$ is selected from the group consisting of —COOH (the naturally occurring C-terminal carboxylate), -Asn-COOH, Asn-Thr-COOH, and Y—COOH, wherein Y is 1 to 2 amino acids.

Exemplary further amino acid modifications to the foregoing Class 1 glucagon related peptides or analogs include substitution of Thr at position 7 with an amino acid lacking a hydroxyl group, e.g., aminobutyric acid (Abu), Ile, optionally, in combination with substitution or addition of an amino acid comprising a side chain covalently attached (optionally, through a spacer) to an acyl or alkyl group, which acyl or alkyl group is non-native to a naturally-occurring amino acid, substitution of Lys at position 12 with Arg; substitution of Asp at position 15 with Glu; substitution of Ser at position 16 with Thr or AIB; substitution of Gln at position 20 with Ser, Thr, Ala or AIB; substitution of Asp at position 21 with Glu; substitution of Gln at position 24 with Ser, Thr, Ala or AIB; substitution of Met at position 27 with Leu or Nle; substitution of Asn at position 28 with a charged amino acid; substitution of Asn at position 28 with a charged amino acid selected from the group consisting of Lys, Arg, His, Asp, Glu, cysteic acid, and homocysteic acid; substitution at position 28 with Asn, Asp, or Glu; substitution at position 28 with Asp; substitution at position 28 with Glu; substitution of Thr at position 29 with a charged amino acid; substitution of Thr at position 29 with a charged amino acid selected from the group consisting of Lys, Arg, His, Asp, Glu, cysteic acid, and homocysteic acid; substitution at position 29 with Asp, Glu, or Lys; substitution at position 29 with Glu; insertion of 1-3 charged amino acids after position 29; insertion at position 30 (i.e., after position 29) of Glu or Lys; optionally with insertion at position 31 of Lys; addition of SEQ ID NO: 820 to the C-terminus, optionally, wherein the amino acid at position 29 is Thr or Gly; substitution or addition of an amino acid covalently attached to a hydrophilic moiety; or a combination thereof.

Any of the modifications described above in reference to Class 1 glucagon agonists which increase glucagon receptor activity, retain partial glucagon receptor activity, improve solubility, increase stability, or reduce degradation can be applied to Class 1 glucagon related peptides individually or in combination.

Examples of Embodiments of Class 1 Glucagon Related Peptides

In accordance with some embodiments the native glucagon peptide of SEQ ID NO: 801 is modified by the substitution of the native amino acid at position 28 and/or 29 with a negatively charged amino acid (e.g., aspartic acid or glutamic acid) and optionally the addition of a negatively charged amino acid (e.g., aspartic acid or glutamic acid) to the carboxy terminus of the peptide. In an alternative embodiment the native glucagon peptide of SEQ ID NO: 801 is modified by the substitution of the native amino acid at position 29 with a positively charged amino acid (e.g., lysine, arginine or histidine) and optionally the addition of one or two positively charged amino acid (e.g., lysine, arginine or histidine) on the carboxy terminus of the peptide. In accordance with some embodiments a glucagon analog having improved solubility and stability is provided wherein the analog comprises the amino acid sequence of SEQ ID NO: 834 with the proviso that at least one amino acids at position, 28, or 29 is substituted with an acidic amino acid and/or an additional acidic amino acid is added at the carboxy terminus of SEQ ID NO: 834. In some embodiments the acidic amino acids are independently selected from the group consisting of Asp, Glu, cysteic acid and homocysteic acid.

In accordance with some embodiments a glucagon agonist having improved solubility and stability is provided wherein the agonist comprises the amino acid sequence of SEQ ID NO: 833, wherein at least one of the amino acids at positions 27, 28 or 29 is substituted with a non-native amino acid residue (i.e. at least one amino acid present at position 27, 28 or 29 of the analog is an acid amino acid different from the amino acid present at the corresponding position in SEQ ID NO: 801). In accordance with some embodiments a glucagon agonist is provided comprising the sequence of SEQ ID NO: 833 with the proviso that when the amino acid at position 28 is asparagine and the amino acid at position 29 is threonine, the peptide further comprises one to two amino acids, independently selected from the group consisting of Lys, Arg, His, Asp or Glu, added to the carboxy terminus of the glucagon related peptide. In accordance with some embodiments the methionine residue present at position 27 of the native peptide is changed to leucine or norleucine to prevent oxidative degradation of the peptide.

In some embodiments a glucagon analog of SEQ ID NO: 833 is provided wherein 1 to 6 amino acids, selected from positions 1, 2, 5, 7, 10, 11, 12, 13, 14, 16, 17, 18, 19, 20, 21 or 24 of the analog differ from the corresponding amino acid of SEQ ID NO: 801. In accordance with another embodiment a glucagon analog of SEQ ID NO: 833 is provided wherein 1 to 3 amino acids selected from positions 1, 2, 5, 7, 10, 11, 12, 13, 14, 16, 17, 18, 19, 20, 21 or 24 of the analog differ from the corresponding amino acid of SEQ ID NO: 801. In another embodiment, a glucagon analog of SEQ ID NO: 807, SEQ ID NO: 808 or SEQ ID NO: 834 is provided wherein 1 to 2 amino acids selected from positions 1, 2, 5, 7, 10, 11, 12, 13, 14, 16, 17, 18, 19, 20, 21 or 24 of the analog differ from the corresponding amino acid of SEQ ID NO: 801, and in a further embodiment those one to two differing amino acids represent conservative amino acid substitutions relative to the amino acid present in the native sequence (SEQ ID NO: 801). In some embodiments a glucagon related peptide of SEQ ID NO: 811 or SEQ ID NO: 813 is provided wherein the glucagon related peptide further comprises one, two or three amino acid substitutions at positions selected from positions 2, 5, 7, 10, 11, 12, 13, 14, 16, 17, 18, 19, 20, 21, 24, 27 or 29. In some embodiments the substitutions at positions 2, 5, 7, 10, 11, 12, 13, 14, 16, 17, 18, 19, 20, 27 or 29 are conservative amino acid substitutions.

In some embodiments a glucagon agonist is provided comprising an analog peptide of SEQ ID NO: 801 wherein the analog differs from SEQ ID NO: 801 by having an amino acid other than serine at position 2 and by having an acidic amino acid substituted for the native amino acid at position 28 or 29 or an acidic amino acid added to the carboxy terminus of the peptide of SEQ ID NO: 801. In some embodiments the acidic amino acid is aspartic acid or glutamic acid. In some embodiments a glucagon analog of SEQ ID NO: 809, SEQ ID NO: 812, SEQ ID NO: 813 or SEQ ID NO: 832 is provided wherein the analog differs from the parent molecule by a substitution at position 2. More particularly, position 2 of the analog peptide is substituted with an amino acid selected from the group consisting of D-serine, alanine, D-alanine, glycine, n-methyl serine and aminoisobutyric acid.

In another embodiment a glucagon agonist is provided comprising an analog peptide of SEQ ID NO: 801 wherein the analog differs from SEQ ID NO: 801 by having an amino acid other than histidine at position 1 and by having an acidic amino acid substituted for the native amino acid at position 28 or 29 or an acidic amino acid added to the carboxy terminus of the peptide of SEQ ID NO: 801. In some embodiments the acidic amino acid is aspartic acid or glutamic acid. In some embodiments a glucagon analog of SEQ ID NO: 809, SEQ ID NO: 812, SEQ ID NO: 813 or SEQ ID NO: 832 is provided wherein the analog differs from the parent molecule by a substitution at position 1. More particularly, position 1 of the analog peptide is substituted with an amino acid selected from the group consisting of DMIA, D-histidine, desaminohistidine, hydroxyl-histidine, acetyl-histidine and homo-histidine.

In accordance with some embodiments the modified glucagon related peptide comprises a sequence selected from the group consisting of SEQ ID NO: 809, SEQ ID NO: 812, SEQ ID NO: 813 and SEQ ID NO: 832. In a further embodiment a glucagon related peptide is provided comprising a sequence of SEQ ID NO: 809, SEQ ID NO: 812, SEQ ID NO: 813 or SEQ ID NO: 832 further comprising one to two amino acids, added to the C-terminus of SEQ ID NO: 809, SEQ ID NO: 812, SEQ ID NO: 813 or SEQ ID NO: 832, wherein the additional amino acids are independently selected from the group consisting of Lys, Arg, His, Asp Glu, cysteic acid or homocysteic acid. In some embodiments the additional amino acids added to the carboxy terminus are selected from the group consisting of Lys, Arg, His, Asp or Glu or in a further embodiment the additional amino acids are Asp or Glu.

In another embodiment the glucagon related peptide comprises the sequence of SEQ ID NO: 7 or a glucagon agonist analog thereof. In some embodiments the peptide comprising a sequence selected from the group consisting of SEQ ID NO: 808, SEQ ID NO: 810, SEQ ID NO: 811, SEQ ID NO: 812 and SEQ ID NO: 813. In another embodiment the peptide comprising a sequence selected from the group consisting of SEQ ID NO: 808, SEQ ID NO: 810 and SEQ ID NO: 811. In some embodiments the glucagon related peptide comprises the sequence of SEQ ID NO: 808, SEQ ID NO: 810 and SEQ ID NO: 811 further comprising an additional amino acid, selected from the group consisting of Asp and Glu, added to the C-terminus of the glucagon related peptide. In some embodiments the glucagon related peptide comprises the sequence of SEQ ID NO: 811 or SEQ ID NO: 813, and in a further embodiment the glucagon related peptide comprises the sequence of SEQ ID NO: 811.

In accordance with some embodiments a glucagon agonist is provided comprising a modified glucagon related peptide selected from the group consisting of:

NH$_2$-His-Ser-Gln-Gly-Thr-Phe-Thr-Ser-Asp-Tyr-Ser-Lys-Tyr-Leu-Xaa-Ser-Arg-Arg-Ala-Gln-Asp-Phe-Val-Gln-Trp-Leu-Xaa-Xaa-Xaa-R (SEQ ID NO: 834),

NH$_2$-His-Ser-Gln-Gly-Thr-Phe-Thr-Ser-Asp-Tyr-Ser-Lys-Tyr-Leu-Asp-Ser-Arg-Arg-Ala-Gln-Asp-Phe-Val-Gln-Trp-Leu-Met-Asp-Thr-R (SEQ ID NO: 811) and NH$_2$-His-Ser-Gln-Gly-Thr-Phe-Thr-Ser-Asp-Tyr-Ser-Xaa-Tyr-Leu-Glu-Ser-Arg-Arg-Ala-Gln-Asp-Phe-Val-Gln-Trp-Leu-Met-Asp-Thr-R (SEQ ID NO: 813)

wherein Xaa at position 15 is Asp, Glu, cysteic acid, homoglutamic acid or homocysteic acid, the Xaa at position 28 is Asn or an acidic amino acid and the Xaa at position 29 is Thr or an acidic amino acid and R is an acidic amino acid, COOH or CONH$_2$, with the proviso that an acidic acid residue is present at one of positions 28, 29 or 30. In some embodiments R is COOH, and in another embodiment R is CONH$_2$.

The present disclosure also encompasses glucagon fusion peptides wherein a second peptide has been fused to the C-terminus of the glucagon related peptide to enhance the stability and solubility of the glucagon related peptide. More particularly, the fusion glucagon related peptide may comprise a glucagon agonist analog comprising a glucagon related peptide NH$_2$-His-Ser-Gln-Gly-Thr-Phe-Thr-Ser-Asp-Tyr-Ser-Lys-Tyr-Leu-Xaa-Ser-Arg-Arg-Ala-Gln-Asp-Phe-Val-Gln-Trp-Leu-Xaa-Xaa-Xaa-R (SEQ ID NO: 834), wherein R is an acidic amino acid or a bond and an amino acid sequence of SEQ ID NO: 820 (GPSSGAPPPS), SEQ ID NO: 821 (KRNRNNIA) or SEQ ID NO: 822 (KRNR) linked to the carboxy terminal amino acid of the glucagon related peptide. In some embodiments the glucagon related peptide is selected from the group consisting of SEQ ID NO: 833, SEQ ID NO: 807 or SEQ ID NO: 808 further comprising an amino acid sequence of SEQ ID NO: 820 (GPSSGAPPPS), SEQ ID NO: 821 (KRNRNNIA) or SEQ ID NO: 822 (KRNR) linked to the carboxy terminal amino acid of the glucagon related peptide. In some embodiments the glucagon fusion peptide comprises SEQ ID NO: 802, SEQ ID NO: 803, SEQ ID NO: 804, SEQ ID NO: 805 and SEQ ID NO: 806 or a glucagon agonist analog thereof, further comprising an amino acid sequence of SEQ ID NO: 820 (GPSSGAPPPS), SEQ ID NO: 821 (KRNRNNIA) or SEQ ID NO: 822 (KRNR) linked to amino acid 29 of the glucagon related peptide. In accordance with some embodiments the fusion peptide further comprises a PEG chain linked to an amino acid at position 16, 17, 21, 24, 29, within a C-terminal extension, or at the C-terminal amino acid, wherein the PEG chain is selected from the range of 500 to 40,000 Daltons. In some embodiments the amino acid sequence of SEQ ID NO: 820 (GPSSGAPPPS), SEQ ID NO: 821 (KRNRNNIA) or SEQ ID NO: 822 (KRNR) is bound to amino acid 29 of the glucagon related peptide through a peptide bond. In some embodiments the glucagon related peptide portion of the glucagon fusion peptide comprises a sequence selected from the group consisting of SEQ ID NO: 810, SEQ ID NO: 811 and SEQ ID NO: 813. In some embodiments the glucagon related peptide portion of the glucagon fusion peptide comprises the sequence of SEQ ID NO: 811 or SEQ ID NO: 813, wherein a PEG chain is linked at position 21, 24, 29, within a C-terminal extension or at the C-terminal amino acid, respectively.

In another embodiment the glucagon related peptide sequence of the fusion peptide comprises the sequence of SEQ ID NO: 811, further comprising an amino acid sequence of SEQ ID NO: 820 (GPSSGAPPPS), SEQ ID NO: 821 (KRNRNNIA) or SEQ ID NO: 822 (KRNR) linked to amino acid 29 of the glucagon related peptide. In some embodiments the glucagon fusion peptide comprises a sequence selected from the group consisting of SEQ ID NO: 824, SEQ ID NO: 825 and SEQ ID NO: 826. Typically the fusion peptides of the present invention will have a C-terminal amino acid with the standard carboxylic acid group. However, analogs of those sequences wherein the C-terminal amino acid has an amide substituted for the carboxylic acid are also encompassed as embodiments. In accordance with some embodiments the fusion glucagon related peptide comprises a glucagon agonist analog selected from the group consisting of SEQ ID NO: 810, SEQ ID NO: 811 and SEQ ID NO: 813, further comprising an amino acid sequence of SEQ ID NO: 823 (GPSSGAPPPS-CONH$_2$) linked to amino acid 29 of the glucagon related peptide.

The glucagon agonists of the present invention can be further modified to improve the peptide's solubility and stability in aqueous solutions while retaining the biological activity of the glucagon related peptide. In accordance with some embodiments, introduction of hydrophilic groups at one or more positions selected from positions 16, 17, 20, 21, 24 and 29 of the peptide of SEQ ID NO: 811, or a glucagon agonist analog thereof, are anticipated to improve the solubility and stability of the pH stabilize glucagon analog. More particularly, in some embodiments the glucagon related peptide of SEQ ID NO: 810, SEQ ID NO: 811, SEQ ID NO: 813, or SEQ ID NO: 832 is modified to comprise one or more hydrophilic groups covalently linked to the side chains of amino acids present at positions 21 and 24 of the glucagon related peptide.

In accordance with some embodiments, the glucagon related peptide of SEQ ID NO: 811 is modified to contain one or more amino acid substitution at positions 16, 17, 20, 21, 24 and/or 29, wherein the native amino acid is substituted with an amino acid having a side chain suitable for crosslinking with hydrophilic moieties, including for example, PEG. The native peptide can be substituted with a naturally occurring amino acid or a synthetic (non-naturally occurring) amino acid. Synthetic or non-naturally occurring amino acids refer to amino acids that do not naturally occur in vivo but which, nevertheless, can be incorporated into the peptide structures described herein.

In some embodiments, a glucagon agonist of SEQ ID NO: 810, SEQ ID NO: 811 or SEQ ID NO: 813 is provided wherein the native glucagon peptide sequence has been modified to contain a naturally occurring or synthetic amino acid in at least one of positions 16, 17, 21, 24, 29, within a C-terminal extension or at the C-terminal amino acid of the native sequence, wherein the amino acid substitute further comprises a hydrophilic moiety. In some embodiments the substitution is at position 21 or 24, and in a further embodiment the hydrophilic moiety is a PEG chain. In some embodiments the glucagon related peptide of SEQ ID NO: 811 is substituted with at least one cysteine residue, wherein the side chain of the cysteine residue is further modified with a thiol reactive reagent, including for example, maleimido, vinyl sulfone, 2-pyridylthio, haloalkyl, and haloacyl. These thiol reactive reagents may contain carboxy, keto, hydroxyl, and ether groups as well as other hydrophilic moieties such as polyethylene glycol units. In an alternative embodiment, the native glucagon peptide is substituted with lysine, and the side chain of the substituting lysine residue is further modified using amine reactive reagents such as active esters (succinimido, anhydride, etc) of carboxylic acids or aldehydes of hydrophilic moieties such as polyethylene glycol. In some embodiments the glucagon related peptide is selected from the group consisting of SEQ ID NO: 814, SEQ ID NO: 815, SEQ ID NO: 816, SEQ ID NO: 817, SEQ ID NO: 818 and SEQ ID NO: 819.

In accordance with some embodiments the pegylated glucagon related peptide comprises two or more polyethylene glycol chains covalently bound to the glucagon related peptide wherein the total molecular weight of the glucagon chains is about 1,000 to about 5,000 Daltons. In some embodiments the pegylated glucagon agonist comprises a peptide of SEQ ID NO: 806, wherein a PEG chain is covalently linked to the amino acid residue at position 21 and at position 24, and wherein the combined molecular weight of the two PEG chains is about 1,000 to about 5,000 Daltons. In another embodiment the pegylated glucagon agonist comprises a peptide of SEQ ID NO: 806, wherein a PEG chain is covalently linked to the amino acid residue at position 21 and at position 24, and wherein the combined molecular weight of the two PEG chains is about 5,000 to about 20,000 Daltons.

The polyethylene glycol chain may be in the form of a straight chain or it may be branched. In accordance with some embodiments the polyethylene glycol chain has an average molecular weight selected from the range of about 500 to about 40,000 Daltons. In some embodiments the polyethylene glycol chain has a molecular weight selected from the range of about 500 to about 5,000 Daltons. In another embodiment the polyethylene glycol chain has a molecular weight of about 20,000 to about 40,000 Daltons.

Any of the glucagon related peptides described above may be further modified to include a covalent or non-covalent intramolecular bridge or an alpha helix-stabilizing amino acid within the C-terminal portion of the glucagon related peptide (amino acid positions 12-29). In accordance with some embodiments, the glucagon related peptide comprises any one or more of the modifications discussed above in addition to an amino acid substitution at positions 16, 20, 21, or 24 (or a combination thereof) with an α,α-disubstituted amino acid, e.g., AIB. In accordance with another embodiment, the glucagon related peptide comprises any one or more modifications discussed above in addition to an intramolecular bridge, e.g., a lactam, between the side chains of the amino acids at positions 16 and 20 of the glucagon related peptide.

In accordance with some embodiments, the glucagon related peptide comprises the amino acid sequence of SEQ ID NO: 877, wherein the Xaa at position 3 is an amino acid comprising a side chain of Structure I, II, or III:

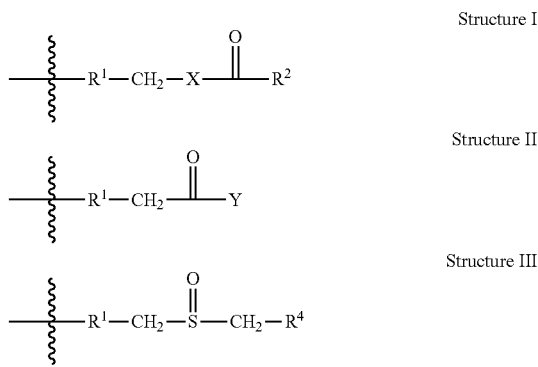

wherein $R^1$ is $C_{0-3}$ alkyl or $C_{0-3}$ heteroalkyl; $R^2$ is $NHR^4$ or $C_{1-3}$ alkyl; $R^3$ is $C_{1-3}$ alkyl; $R^4$ is H or $C_{1-3}$ alkyl; X is NH, O, or S; and Y is $NHR^4$, $SR^3$, or $OR^3$. In some embodiments, X is NH or Y is $NHR^4$. In some embodiments, $R^1$ is $C_{0-2}$ alkyl or $C_1$ heteroalkyl. In some embodiments, $R^2$ is $NHR^4$ or $C_1$ alkyl. In some embodiments, $R^4$ is H or $C^1$ alkyl. In exemplary embodiments an amino acid comprising a side chain of Structure I is provided wherein, $R^1$ is $CH_2$—S, X is NH, and $R^2$ is $CH_3$ (acetamidomethyl-cysteine, C(Acm)); $R^1$ is $CH_2$, X is NH, and $R^2$ is $CH_3$ (acetyldiaminobutanoic acid, Dab(Ac)); $R^1$ is $C_0$ alkyl, X is NH, $R^2$ is $NHR^4$, and $R^4$ is H (carbamoyldiaminopropanoic acid, Dap(urea)); or $R^1$ is $CH_2$—$CH_2$, X is NH, and $R^2$ is $CH_3$ (acetylornithine, Orn (Ac)). In exemplary embodiments an amino acid comprising a side chain of Structure II is provided, wherein $R^1$ is $CH_2$, Y is $NHR^4$, and $R^4$ is $CH_3$ (methylglutamine, Q(Me)); In exemplary embodiments an amino acid comprising a side chain of Structure III is provided wherein, $R^1$ is $CH_2$ and $R^4$ is H (methionine-sulfoxide, M(O)); In specific embodiments, the amino acid at position 3 is substituted with Dab(Ac). For example, glucagon agonists can comprise the amino acid sequence of SEQ ID NO: 863, SEQ ID NO: 869, SEQ ID NO: 871, SEQ ID NO: 872, SEQ ID NO: 873 and SEQ ID NO: 874.

In certain embodiments, the glucagon related peptide is an analog of the glucagon related peptide of SEQ ID NO: 877. In specific aspects, the analog comprises any of the amino acid modifications described herein, including, but not limited to: a substitution of Asn at position 28 with a charged amino acid; a substitution of Asn at position 28 with a charged amino acid selected from the group consisting of Lys, Arg, His, Asp, Glu, cysteic acid, and homocysteic acid; a substitution at position 28 with Asn, Asp, or Glu; a substitution at position 28 with Asp; a substitution at position 28 with Glu; a substitution of Thr at position 29 with a charged amino acid; a substitution of Thr at position 29 with a charged amino acid selected from the group consisting of Lys, Arg, His, Asp, Glu, cysteic acid, and homocysteic acid; a substitution at position 29 with Asp, Glu, or Lys; a substitution at position 29 with Glu; a insertion of 1-3 charged amino acids after position 29; an insertion after position 29 of Glu or Lys; an insertion after position 29 of Gly-Lys or Lys-Lys; and a combination thereof.

In certain embodiments, the analog of the glucagon related peptide of SEQ ID NO: 877 comprises an α,α-disubstituted amino acid, such as AIB, at one, two, three, or all of positions 16, 20, 21, and 24. In certain embodiments, the analog of the glucagon related peptide of SEQ ID NO: 877 comprises one or more of the following: substitution of His at position 1 with a non-native amino acid that reduces susceptibility of the glucagon related peptide to cleavage by dipeptidyl peptidase IV (DPP-IV), substitution of Ser at position 2 with a non-native amino acid that reduces susceptibility of the glucagon related peptide to cleavage by dipeptidyl peptidase IV (DPP-IV), substitution of Thr at position 7 with an amino acid lacking a hydroxyl group, e.g., Abu or Ile; substitution of Tyr at position 10 with Phe or Val; substitution of Lys at position 12 with Arg; substitution of Asp at position 15 with Glu, substitution of Ser at position 16 with Thr or AIB; substitution of Gln at position 20 with Ala or AIB; substitution of Asp at position 21 with Glu; substitution of Gln at position 24 with Ala or AIB; substitution of Met at position 27 with Leu or Nle; deletion of amino acids at positions 27-29; deletion of amino acids at positions 28-29; deletion of the amino acid at positions 29; addition of the amino acid sequence of SEQ ID NO: 820 to the C-terminus, wherein the amino acid at position 29 is Thr or Gly, or a combination thereof.

In accordance with specific embodiments, the glucagon related peptide comprises the amino acid sequence of any of SEQ ID NOs: 862-867 and 869-874. In certain embodiments, the analog of the glucagon related peptide comprising SEQ ID NO: 877 comprises a hydrophilic moiety, e.g., PEG, covalently linked to the amino acid at any of positions 16, 17, 20, 21, 24, and 29 or at the C-terminal amino acid.

In certain embodiments, the analog of the glucagon related peptide comprising SEQ ID NO: 877 comprises an amino acid comprising a side chain covalently attached, optionally, through a spacer, to an acyl group or an alkyl group, which acyl group or alkyl group is non-native to a naturally-occurring amino acid. The acyl group in some embodiments is a C4 to C30 fatty acyl group. In other embodiments, the alkyl group is a C4 to C30 alkyl. In specific aspects, the acyl group or alkyl group is covalently attached to the side chain of the amino acid at position 10. In some embodiments, the amino acid at position 7 is Ile or Abu.

The glucagon agonist may be a peptide comprising the amino acid sequence of any of the SEQ ID NOs: 801-919, optionally with up to 1, 2, 3, 4, or 5 further modifications that retain glucagon agonist activity. In certain embodiments, the glucagon agonist comprises the amino acids of any of SEQ ID NOs: 859-919.

Class 2 Glucagon Related Peptides

In certain embodiments, the glucagon related peptide is a Class 2 glucagon related peptide, which is described herein and in International Patent Application No. PCT US2009/47447 (filed on Jun. 16, 2009), U.S. Provisional Application No. 61/090,448, and U.S. Application No. 61/151,349, the contents of which are incorporated by reference in their entirety. The biological sequences referenced in the following section (SEQ ID NOs: 1001-1262) relating to Class 2 glucagon related peptides correspond to SEQ ID NOs: 1-262 in International Patent Application No. PCT US2009/47447.

Activity

Native glucagon does not activate the GIP receptor, and normally has about 1% of the activity of native-GLP-1 at the GLP-1 receptor. Modifications to the native glucagon sequence described herein produce Class 2 glucagon related peptides that can exhibit potent glucagon activity equivalent to or better than the activity of native glucagon (SEQ ID NO: 1001), potent GIP activity equivalent to or better than the activity of native GIP (SEQ ID NO: 1004), and/or potent GLP-1 activity equivalent to or better than the activity of native GLP-1. In this regard, the Class 2 glucagon related peptide may be one of a glucagon/GIP co-agonist, glucagon/GIP/GLP-1 tri-agonist, GIP/GLP-1 co-agonist, or a GIP agonist glucagon related peptide, as further described herein.

In some embodiments, the Class 2 glucagon related peptides described herein exhibit an EC50 for GIP receptor activation activity of about 100 nM or less, or about 75, 50, 25, 10, 8, 6, 5, 4, 3, 2 or 1 nM or less. In some embodiments, the Class 2 glucagon related peptides exhibit an EC50 for glucagon receptor activation of about 100 nM or less, or about 75, 50, 25, 10, 8, 6, 5, 4, 3, 2 or 1 nM or less. In some embodiments, the Class 2 glucagon related peptides exhibit an EC50 for GLP-1 receptor activation of about 100 nM or less, or about 75, 50, 25, 10, 8, 6, 5, 4, 3, 2 or 1 nM or less. Receptor activation can be measured by in vitro assays measuring cAMP induction in HEK293 cells over-expressing the receptor, e.g. assaying HEK293 cells co-transfected with DNA encoding the receptor and a luciferase gene linked to cAMP responsive element as described in Example 7.

In some embodiments, Class 2 glucagon related peptides exhibit activity at both the glucagon receptor and the GIP receptor ("glucagon/GIP co-agonists"). These Class 2 glucagon related peptides have lost native glucagon's selectivity for glucagon receptor compared to GIP receptor. In some embodiments, the EC50 of the Class 2 glucagon related peptide at the GIP receptor is less than about 50-fold, 40-fold, 30-fold or 20-fold different (higher or lower) from its EC50 at the glucagon receptor. In some embodiments, the GIP potency of the Class 2 glucagon related peptide is less than about 500-, 450-, 400-, 350-, 300-, 250-, 200-, 150-, 100-, 75-, 50-, 25-, 20-, 15-, 10-, or 5-fold different (higher or lower) from its glucagon potency. In some embodiments, the ratio of the EC50 of the Class 2 glucagon related peptide at the GIP receptor divided by the EC50 of the Class 2 glucagon related peptide at the glucagon receptor is less than about 100, 75, 60, 50, 40, 30, 20, 15, 10, or 5. In some embodiments, GLP-1 activity have been significantly reduced or destroyed, e.g., by an amino acid modification at position 7, a deletion of the amino acid(s) C-terminal to the amino acid at position 27 or 28, yielding a 27- or 28-amino acid peptide, or a combination thereof.

In another aspect, Class 2 glucagon related peptides exhibit activity at the glucagon, GIP and GLP-1 receptors ("glucagon/GIP/GLP-1 tri-agonists"). These Class 2 glucagon related peptides have lost native glucagon's selectivity for the glucagon receptor compared to both the GLP-1 and GIP receptors. In some embodiments, the EC50 of the Class 2 glucagon related peptide at the GIP receptor is less than about 50-fold, 40-fold, 30-fold or 20-fold different (higher or lower) from its respective EC50s at the glucagon and GLP-1 receptors. In some embodiments, the GIP potency of the Class 2 glucagon related peptide is less than about 500-, 450-, 400-, 350-, 300-, 250-, 200-, 150-, 100-, 75-, 50-, 25-, 20-, 15-, 10-, or 5-fold different (higher or lower) from its glucagon and GLP-1 potencies. In some embodiments, the ratio of the EC50 of the tri-agonist at the GIP receptor divided by the EC50 of the tri-agonist at the GLP-1 receptor is less than about 100, 75, 60, 50, 40, 30, 20, 15, 10, or 5.

In yet another aspect, Class 2 glucagon related peptides exhibit activity at the GLP-1 and GIP receptors, but in which the glucagon activity has been significantly reduced or destroyed ("GIP/GLP-1 co-agonists"), e.g., by an amino acid modification at position 3. For example, substitution at this position with an acidic, basic, or a hydrophobic amino acid (glutamic acid, ornithine, norleucine) reduces glucagon activity. In some embodiments, the EC50 of the glucagon related peptide at the GIP receptor is less than about 50-fold, 40-fold, 30-fold or 20-fold different (higher or lower) from its EC50 at the GLP-1 receptor. In some embodiments, the GIP potency of the Class 2 glucagon related peptide is less than about 25-, 20-, 15-, 10-, or 5-fold different (higher or lower) from its GLP-1 potency. In some embodiments these Class 2 glucagon related peptides have about 10% or less of the activity of native glucagon at the glucagon receptor, e.g. about 1-10%, or about 0.1-10%, or greater than about 0.1% but less than about 10%. In some embodiments, the ratio of the EC50 of the Class 2 glucagon related peptide at the GIP receptor divided by the EC50 of the Class 2 glucagon related peptide at the GLP-1 receptor is less than about 100, 75, 60, 50, 40, 30, 20, 15, 10, or 5, and no less than 1. In some embodiments, the ratio of the GIP potency of the Class 2 glucagon related peptide compared to the GLP-1 potency of the Class 2 glucagon related peptide is less than about 100, 75, 60, 50, 40, 30, 20, 15, 10, or 5, and no less than 1.

In a further aspect, Class 2 glucagon related peptides exhibit activity at the GIP receptor, in which the glucagon and GLP-1 activity have been significantly reduced or destroyed ("GIP agonist glucagon peptides"), e.g., by amino acid modifications at positions 3 with Glu and 7 with Ile. In some embodiments, these Class 2 glucagon related peptides have about 10% or less of the activity of native glucagon at the glucagon receptor, e.g. about 1-10%, or about 0.1-10%, or greater than about 0.1%, 0.5%, or 1% but less than about 1%, 5%, or 10%. In some embodiments these Class 2 glucagon related peptides also have about 10% or less of the activity of native GLP-1 at the GLP-1 receptor, e.g. about 1-10%, or about 0.1-10%, or greater than about 0.1%, 0.5%, or 1% but less than about 1%, 5%, or 10%.

Modifications

The modifications disclosed herein in reference to a Class 2 glucagon related peptide permit the manipulation of glucagon (SEQ ID NO: 1001) to create glucagon related peptides that exhibit increased GIP activity, glucagon activity, and/or GLP-1 activity.

Modifications that Affect GIP Activity

Enhanced activity at the GIP receptor is provided by an amino acid modification at position 1. For example, His at position 1 is substituted with a large, aromatic amino acid, optionally Tyr, Phe, Trp, amino-Phe, nitro-Phe, chloro-Phe, sulfo-Phe, 4-pyridyl-Ala, methyl-Tyr, or 3-amino Tyr. The combination of Tyr at position 1 with stabilization of the alpha helix within the region corresponding to amino acids 12-29 provided a Class 2 glucagon related peptide that activates the GIP receptor as well as the GLP-1 receptor and the glucagon receptor. The alpha helix structure can be stabilized by, e.g., formation of a covalent or non-covalent intramolecular bridge, or substitution and/or insertion of amino acids around positions 12-29 with an alpha helix-stabilizing amino acid (e.g., an α,α-disubstituted amino acid).

Enhanced activity at the GIP receptor is also provided by amino acid modifications at positions 27 and/or 28, and optionally at position 29. For example, the Met at position 27 is substituted with a large aliphatic amino acid, optionally Leu, the Asn at position 28 is substituted with a small aliphatic amino acid, optionally Ala, and the Thr at position 29 is substituted with a small aliphatic amino acid, optionally Gly. Substitution with LAG at positions 27-29 provides increased GIP activity relative to the native MNT sequence at those positions.

Enhanced activity at the GIP receptor is also provided by an amino acid modification at position 12. For example, position 12 is substituted with a large, aliphatic, nonpolar amino acid, optionally Ile. Enhanced activity at the GIP receptor is also provided by an amino acid modification at positions 17 and/or 18. For example, position 17 is substituted with a polar residue, optionally Gln, and position 18 is substituted with a small aliphatic amino acid, optionally Ala. A substitution with QA at positions 17 and 18 provides increased GIP activity relative to the native RR sequence at those positions.

Increased activity at the GIP receptor is provided by modifications that permit formation of an intramolecular bridge between amino acid side chains at positions from 12 to 29. For example, an intramolecular bridge can be formed by a covalent bond between the side chains of two amino acids at positions i and i+4 or between positions j and j+3, or between positions k and k+7. In exemplary embodiments, the bridge is between positions 12 and 16, 16 and 20, 20 and 24, 24 and 28, or 17 and 20. In other embodiments, non-covalent interactions such as salt bridges can be formed between positively and negatively charged amino acids at these positions.

Any of the modifications described above which increase GIP receptor activity can be applied individually or in combination. Combinations of the modifications that increase GIP receptor activity generally provide higher GIP activity than any of such modifications taken alone.

Modifications that Affect Glucagon Activity

In some embodiments, enhanced glucagon potency is provided by an amino acid modification at position 16 of native glucagon (SEQ ID NO: 1001). By way of nonlimiting example, such enhanced potency can be provided by substituting the naturally occurring serine at position 16 with glutamic acid or with another negatively charged amino acid having a side chain with a length of 4 atoms, or alternatively with any one of glutamine, homoglutamic acid, or homocysteic acid, or a charged amino acid having a side chain containing at least one heteroatom, (e.g. N, O, S, P) and with a side chain length of about 4 (or 3-5) atoms. In some embodiments the glucagon related peptide retains its original selectivity for the glucagon receptor relative to the GLP-1 receptors.

Glucagon receptor activity can be reduced by an amino acid modification at position 3, e.g. substitution of the naturally occurring glutamine at position 3, with an acidic, basic, or a hydrophobic amino acid. For example substitution at position 3 with glutamic acid, ornithine, or norleucine substantially reduces or destroys glucagon receptor activity.

Maintained or enhanced activity at the glucagon receptor may be achieved by modifying the Gln at position 3 with a glutamine analog, as described herein. For example, glucagon agonists can comprise the amino acid sequence of any of SEQ ID NOs: 1243-1248, 1250, 1251, and 1253-1256.

Restoration of glucagon activity which has been reduced by amino acid modifications at positions 1 and 2 is provided by modifications that that stabilize the alpha helix structure of the C-terminal portion (amino acids 12-29) of the glucagon related peptide or analog thereof. For example, an intramolecular bridge can be formed by a covalent bond between the side chains of two amino acids at positions i and i+4 or between positions j and j+3, or between positions k and k+7. In other embodiments, non-covalent interactions such as salt bridges can be formed between positively and negatively charged amino acids at these positions. In yet other embodiments, one or more α,α-disubstituted amino acids are inserted or substituted into this C-terminal portion (amino acids 12-29) at positions that retain the desired activity. For example, one, two, three or all of positions 16, 20, 21 or 24 are substituted with an α,α-disubstituted amino acid, e.g., AIB.

Modifications that Affect GLP-1 Activity

Enhanced activity at the GLP-1 receptor is provided by replacing the carboxylic acid of the C-terminal amino acid with a charge-neutral group, such as an amide or ester. Enhanced activity at the GLP-1 receptor is also provided by stabilizing the alpha-helix structure in the C-terminal portion of glucagon (around amino acids 12-29), e.g., through formation of an intramolecular bridge between the side chains of two amino acids, or substitution and/or insertion of amino acids around positions 12-29 with an alpha helix-stabilizing amino acid (e.g., an α,α-disubstituted amino acid), as further described herein. In exemplary embodiments, the side chains of the amino acid pairs 12 and 16, 13 and 17, 16 and 20, 17 and 21, 20 and 24 or 24 and 28 (amino acid pairs in which i=12, 16, 20, or 24) are linked to one another and thus stabilize the glucagon alpha helix. In some embodiments, the bridge or linker is about 8 (or about 7-9) atoms in length, particularly when the bridge is between positions i and i+4. In some embodiments, the bridge or linker is about 6 (or about 5-7) atoms in length, particularly when the bridge is between positions j and j+3.

In some embodiments, intramolecular bridges are formed by (a) substituting the naturally occurring serine at position 16 with glutamic acid or with another negatively charged amino acid having a side chain with a length of 4 atoms, or alternatively with any one of glutamine, homoglutamic acid, or homocysteic acid, or a charged amino acid having a side chain containing at least one heteroatom, (e.g. N, O, S, P) and with a side chain length of about 4 (or 3-5) atoms, and (b) substituting the naturally occurring glutamine at position 20 with another hydrophilic amino acid having a side chain that is either charged or has an ability to hydrogen-bond, and is at least about 5 (or about 4-6) atoms in length, for example, lysine, citrulline, arginine, or ornithine. The side chains of such amino acids at positions 16 and 20 can form a salt bridge or can be covalently linked. In some embodiments the two amino acids are bound to one another to form a lactam ring.

In some embodiments, stabilization of the alpha helix structure in the C-terminal portion of the glucagon related peptide is achieved through the formation of an intramolecular bridge other than a lactam bridge. For example, suitable covalent bonding methods include any one or more of olefin metathesis, lanthionine-based cyclization, disulfide bridge or modified sulfur-containing bridge formation, the use of α, ω-diaminoalkane tethers, the formation of metal-atom bridges, and other means of peptide cyclization are used to stabilize the alpha helix.

In yet other embodiments, one or more α,α-disubstituted amino acids are inserted or substituted into this C-terminal portion (amino acids 12-29) at positions that retain the desired activity. For example, one, two, three or all of positions 16, 20, 21 or 24 are substituted with an α,α-disubstituted amino acid, e.g., AIB. Increased activity at the GLP-1 receptor is provided by an amino acid modification at position 20 as described herein. Increased activity at the GLP-1 receptor is also provided by adding GPSSGAPPPS (SEQ ID NO: 1095) or XGPSSGAPPPS (SEQ ID NO: 1096) to the C-terminus. GLP-1 activity in such analogs can be further increased by modifying the amino acid at position 18, 28 or 29, or at position 18 and 29, as described herein. A further modest increase in GLP-1 potency is provided by modifying the amino acid at position 10 to be a large, aromatic amino acid residue, optionally Trp. Potency at the GLP-1 receptor can be further enhanced by an alanine substitution for the native arginine at position 18.

Reduced activity at the GLP-1 receptor is provided, e.g., by an amino acid modification at position 7 as described herein.

Any of the modifications described above in reference to a Class 2 glucagon related peptide which increase GLP-1 receptor activity can be applied individually or in combination. Combinations of the modifications that increase GLP-1 receptor activity generally provide higher GLP-1 activity than any of such modifications taken alone. For example, the invention provides glucagon related peptides that comprise modifications at position 16, at position 20, and at the C-terminal carboxylic acid group, optionally with a covalent bond between the amino acids at positions 16 and 20; glucagon related peptides that comprise modifications at position 16 and at the C-terminal carboxylic acid group; glucagon related peptides that comprise modifications at positions 16 and 20, optionally with a covalent bond between the amino acids at positions 16 and 20; and glucagon related peptides that comprise modifications at position 20 and at the C-terminal carboxylic acid group.

Modifications that Improve DPP-IV Resistance

Modifications at position 1 and/or 2 can increase the peptide's resistance to dipeptidyl peptidase IV (DPP IV) cleavage. For example, position 1 and/or position 2 may be substituted with a DPP-IV resistant amino acid as described herein. In some embodiments, the amino acid at position 2 is substituted with N-methyl alanine.

It was observed that modifications at position 2 (e.g. AIB at position 2) and in some cases modifications at position 1 (e.g., DMIA at position 1) may reduce glucagon activity, sometimes significantly; surprisingly, this reduction in glucagon activity can be restored by stabilizing the alpha-helix structure in the C-terminal portion of glucagon (around amino acids 12-29), e.g., through formation of a covalent bond between the side chains of two amino acids, as described herein. In some embodiments, the covalent bond is between amino acids at positions "i" and "i+4", or positions "j" and "j+3", e.g., between positions 12 and 16, 16 and 20, 20 and 24, 24 and 28, or 17 and 20. In exemplary embodiments, this covalent bond is a lactam bridge between a glutamic acid at position 16 and a lysine at position 20. In some embodiments, this covalent bond is an intramolecular bridge other than a lactam bridge, as described herein.

Modifications that Reduce Degradation

In yet further exemplary embodiments, any of the Class 2 glucagon related peptides can be further modified to improve stability by modifying the amino acid at position 15 and/or 16 of SEQ ID NO: 1001 to reduce degradation of the peptide over time, especially in acidic or alkaline buffers. Such modifications reduce cleavage of the Asp15-Ser16 peptide bond. In exemplary embodiments, the amino acid modification at position 15 is a deletion or substitution of Asp with glutamic acid, homoglutamic acid, cysteic acid or homocysteic acid. In other exemplary embodiments, the amino acid modification at position 16 is a deletion or substitution of Ser with Thr or AIB. In other exemplary embodiments, Ser at position 16 is substituted with glutamic acid or with another negatively charged amino acid having a side chain with a length of 4 atoms, or alternatively with any one of glutamine, homoglutamic acid, or homocysteic acid.

In some embodiments, the methionine residue present at position 27 of the native peptide is modified, e.g. by deletion or substitution. Such modifications may prevent oxidative degradation of the peptide. In some embodiments, the Met at position 27 is substituted with leucine, isoleucine or norleucine. In some specific embodiments, Met at position 27 is substituted with leucine or norleucine.

In some embodiments, the Gln at position 20 and/or 24 is modified, e.g. by deletion or substitution. Such modifications can reduce degradation that occurs through deamidation of Gln. In some embodiments, the Gln at position 20 and/or 24 is substituted with Ser, Thr, Ala or AIB. In some embodiments the Gln at position 20 and/or 24 is substituted with Lys, Arg, Orn, or Citrulline.

In some embodiments, the Asp at position 21 is modified, e.g. by deletion or substitution. Such modifications can reduce degradation that occurs through dehydration of Asp to form a cyclic succinimide intermediate followed by isomerization to iso-aspartate. In some embodiments, position 21 is substituted with Glu, homoglutamic acid or homocysteic acid. In some specific embodiments, position 21 is substituted with Glu.

Stabilization of the Alpha Helix Structure

Stabilization of the alpha-helix structure in the C-terminal portion of the Class 2 glucagon related peptide (around amino acids 12-29) provides enhanced GLP-1 and/or GIP activity and restores glucagon activity which has been reduced by amino acid modifications at positions 1 and/or 2. The alpha helix structure can be stabilized by, e.g., formation of a covalent or non-covalent intramolecular bridge, or substitution and/or insertion of amino acids around positions 12-29 with an alpha helix-stabilizing amino acid (e.g., an α,α-disubstituted amino acid). Stabilization of the alpha-helix structure of a GIP agonist may be accomplished as described herein.

Exemplary Embodiments

In accordance with some embodiments of the invention, the analog of glucagon (SEQ ID NO: 1001) having GIP agonist activity comprises SEQ ID NO: 1001 with (a) an amino acid modification at position 1 that confers GIP agonist activity, (b) a modification which stabilizes the alpha helix structure of the C-terminal portion (amino acids 12-29) of the analog, and (c) optionally, 1 to 10 (e.g., 1, 2, 3, 4, 5, 6, 7, 8, 9, 10) further amino acid modifications. In some embodiments, the analog exhibits at least about 1% activity of native GIP at the GIP receptor or any other activity level at the GIP receptor described herein.

In certain embodiments, the modification which stabilizes the alpha helix structure is one which provides or introduces an intramolecular bridge, including, for example, a covalent intramolecular bridge, such as any of those described herein. The covalent intramolecular bridge in some embodiments is a lactam bridge. The lactam bridge of the analog of these embodiments can be a lactam bridge as described herein. See, e.g., the teachings of lactam bridges under the section "Stabilization of the Alpha Helix Structure." For example, the lactam bridge may be one which is between the side chains of amino acids at positions i and i+4 or between the side chains of amino acids at positions j and j+3, wherein i is 12, 13, 16, 17, 20 or 24, and wherein j is 17. In certain embodiments, the lactam bridge can be between the amino acids at positions 16 and 20, wherein one of the amino acids at positions 16 and 20 is substituted with Glu and the other of the amino acids at positions 16 and 20 is substituted with Lys.

In alternative embodiments, the modification which stabilizes the alpha helix structure is the introduction of one, two, three, or four α,α-disubstituted amino acids at position(s) 16, 20, 21, and 24 of the analog. In some embodiments, the α,α-disubstituted amino acid is AIB. In certain aspects, the α,α-disubstituted amino acid (e.g., AIB) is at position 20 and the amino acid at position 16 is substituted with a positive-charged amino acid, such as, for example, an amino acid of Formula IV, which is described herein. The amino acid of Formula IV may be homoLys, Lys, Orn, or 2,4-diaminobutyric acid (Dab).

In specific aspects of the invention, the amino acid modification at position 1 is a substitution of His with an amino acid lacking an imidazole side chain, e.g. a large, aromatic amino acid (e.g., Tyr).

In certain aspects, the analog of glucagon comprises amino acid modifications at one, two or all of positions 27, 28 and 29. For example, the Met at position 27 can be substituted with a large aliphatic amino acid, optionally Leu, the Asn at position 28 can be substituted with a small aliphatic amino acid, optionally Ala, the Thr at position 29 can be substituted with a small aliphatic amino acid, optionally Gly, or a combination of two or three of the foregoing.

In specific embodiments, the analog of glucagon comprises Leu at position 27, Ala at position 28, and Gly or Thr at position 29.

In certain embodiments of the invention, the analog of glucagon comprises an extension of 1 to 21 amino acids C-terminal to the amino acid at position 29. The extension can comprise the amino acid sequence of SEQ ID NO: 1095 or 1096, for instance. Additionally or alternatively, the analog of glucagon can comprise an extension of which 1-6 amino acids of the extension are positive-charged amino acids. The positive-charged amino acids may be amino acids of Formula IV, including, but not limited to Lys, homoLys, Orn, and Dab.

The analog of glucagon in some embodiments is acylated or alkylated as described herein. For instance, the acyl or alkyl group may be attached to the analog of glucagon, with or without a spacer, at position 10 or 40 of the analog, as further described herein. The analog may additionally or alternatively be modified to comprise a hydrophilic moiety as further described herein. Furthermore, in some embodiments, the analog comprises any one or a combination of the following modifications:
(a) Ser at position 2 substituted with D-Ser, Ala, D-Ala, Gly, N-methyl-Ser, AIB, Val, or α-amino-N-butyric acid;
(b) Tyr at position 10 substituted with Trp, Lys, Orn, Glu, Phe, or Val:
(c) Linkage of an acyl group to a Lys at position 10;
(d) Lys at position 12 substituted with Arg or Ile;
(e) Ser at position 16 substituted with Glu, Gln, homoglutamic acid, homocysteic acid, Thr, Gly, or AIB;
(f) Arg at position 17 substituted with Gln;
(g) Arg at position 18 substituted with Ala, Ser, Thr, or Gly;
(h) Gln at position 20 substituted with Ser, Thr, Ala, Lys, Citrulline, Arg, Orn, or AIB;
(i) Asp at position 21 substituted with Glu, homoglutamic acid, homocysteic acid;
(j) Val at position 23 substituted with Ile;
(k) Gln at position 24 substituted with Asn, Ser, Thr, Ala, or AIB;
(l) and a conservative substitution at any of positions 2 5, 9, 10, 11, 12. 13, 14, 15, 16, 8 19 20, 21. 24, 27, 28, and 29.

In exemplary embodiments, the analog of glucagon (SEQ ID NO: 1001) having GIP agonist activity comprises the following modifications:
(a) an amino acid modification at position 1 that confers GIP agonist activity,
(b) a lactam bridge between the side chains of amino acids at positions i and i+4 or between the side chains of amino acids at positions j and j+3, wherein i is 12, 13, 16, 17, 20 or 24, and wherein j is 17,
(c) amino acid modifications at one, two or all of positions 27, 28 and 29, e.g., amino acid modifications at position 27 and/or 28, and
(d) 1-9 or 1-6 further amino acid modifications, e.g. 1, 2, 3, 4, 5, 6, 7, 8 or 9 further amino acid modifications, and the EC50 of the analog for GIP receptor activation is about 10 nM or less.

The lactam bridge of the analog of these embodiments can be a lactam bridge as described herein. For example, the lactam bridge can be between the amino acids at positions 16 and 20, wherein one of the amino acids at positions 16 and 20 is substituted with Glu and the other of the amino acids at positions 16 and 20 is substituted with Lys. In accordance with these embodiments, the analog can comprise, for example, the amino acid sequence of any of SEQ ID NOs: 1005-1094.

In other exemplary embodiments, the analog of glucagon (SEQ ID NO: 1001) having GIP agonist activity comprises the following modifications:
(a) an amino acid modification at position 1 that confers GIP agonist activity,
(b) one, two, three, or all of the amino acids at positions 16, 20, 21, and 24 of the analog is substituted with an α,α-disubstituted amino acid,
(c) amino acid modifications at one, two or all of positions 27, 28 and 29, e.g., amino acid modifications at position 27 and/or 28, and
(d) 1-9 or 1-6 further amino acid modifications, e.g. 1, 2, 3, 4, 5, 6, 7, 8 or 9 further amino acid modifications, and the EC50 of the analog for GIP receptor activation is about 10 nM or less.

The α,α-disubstituted amino acid of the analog of these embodiments can be any α,α-disubstituted amino acid, including, but not limited to, aminoisobutyric acid (AIB), an amino acid disubstituted with the same or a different group selected from methyl, ethyl, propyl, and n-butyl, or with a cyclooctane or cycloheptane (e.g., 1-aminocyclooctane-1-carboxylic acid). In certain embodiments, the α,α-disubstituted amino acid is AIB. In certain embodiments, the amino acid at position 20 is substituted with an α,α-disubstituted amino acid, e.g., AIB. In accordance with these embodiments, the analog can comprise, for example, the amino acid sequence of any of SEQ ID NOs: 1099-1141, 1144-1164, 1166-1169, and 1173-1178.

In yet other exemplary embodiments, the analog of glucagon (SEQ ID NO: 1001) having GIP agonist activity comprises the following modifications:
(a) an amino acid modification at position 1 that confers GIP agonist activity,
(b) an amino acid substitution of Ser at position 16 with an amino acid of Formula IV:

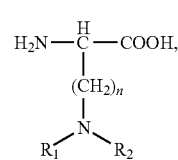

[Formula IV]

wherein n is 1 to 16, or 1 to 10, or 1 to 7, or 1 to 6, or 2 to 6, each of $R_1$ and $R_2$ is independently selected from the group consisting of H, $C_1$-$C_{18}$ alkyl, ($C_1$-$C_{18}$ alkyl)OH, ($C_1$-$C_{18}$ alkyl)$NH_2$, ($C_1$-$C_{18}$ alkyl)SH, ($C_0$-$C_4$ alkyl)($C_3$-$C_6$)cycloalkyl, ($C_0$-$C_4$ alkyl)($C_2$-$C_5$ heterocyclic), ($C_0$-$C_4$ alkyl)($C_6$-$C_{10}$ aryl)$R_7$, and ($C_1$-$C_4$ alkyl)($C_3$-$C_9$ heteroaryl), wherein $R_7$ is H or OH, and the side chain of the amino acid of Formula IV comprises a free amino group,
(c) an amino acid substitution of the Gln at position 20 with an alpha, alpha-disubstituted amino acid,
(d) amino acid modifications at one, two or all of positions 27, 28 and 29, e.g., amino acid modifications at position 27 and/or 28, and
(e) 1-9 or 1-6 further amino acid modifications, e.g. 1, 2, 3, 4, 5, 6, 7, 8 or 9 further amino acid modifications, and the EC50 of the analog for GIP receptor activation is about 10 nM or less.

The amino acid of Formula IV of the analog of these embodiments may be any amino acid, such as, for example, the amino acid of Formula IV, wherein n is 1, 2, 3, 4, 5, 6, 7, 8, 9, 10, 11, 12, 13, 14, 15, or 16. In certain embodiments, n is 2, 3, 4, or 5, in which case, the amino acid is Dab, Orn, Lys, or homoLys respectively.

The alpha, alpha-disubstituted amino acid of the analog of these embodiments may be any alpha, alpha-disubstituted amino acid, including, but not limited to, aminoisobutyric acid (AIB), an amino acid disubstituted with the same or a different group selected from methyl, ethyl, propyl, and n-butyl, or with a cyclooctane or cycloheptane (e.g., 1-aminocyclooctane-1-carboxylic acid). In certain embodiments, the alpha, alpha-disubstituted amino acid is AIB. In accordance with these embodiments, the analog can comprise, for example, the amino acid sequence of any of SEQ ID NOs: 1099-1165.

In yet other exemplary embodiments, the analog of glucagon (SEQ ID NO: 1001) having GIP agonist activity comprises:
  (a) an amino acid modification at position 1 that confers GIP agonist activity, and
  (b) an extension of about 1 to about 21 amino acids C-terminal to the amino acid at position 29, wherein at least one of the amino acids of the extension is acylated or alkylated,
wherein the EC50 of the analog for GIP receptor activation is about 10 nM or less.

In some embodiments, the acylated or alkylated amino acid is an amino acid of Formula I, II, or III. In more specific embodiments, the amino acid of Formula I is Dab, Orn, Lys, or homoLys. Also, in some embodiments, the extension of about 1 to about 21 amino acids comprises the amino acid sequence of GPSSGAPPPS (SEQ ID NO: 1095) or XGPSSGAPPPS (SEQ ID NO: 1096), wherein X is any amino acid, or GPSSGAPPPK (SEQ ID NO: 1170) or XGPSSGAPPPK (SEQ ID NO: 1171) or XGPSSGAPPPSK (SEQ ID NO: 1172), wherein X is Gly or a small, aliphatic or non-polar or slightly polar amino acid. In some embodiments, the about 1 to about 21 amino acids may comprise sequences containing one or more conservative substitutions relative to SEQ ID NO: 1095, 1096, 1170, 1171 or 1172. In some embodiments, the acylated or alkylated amino acid is located at position 37, 38, 39, 40, 41, 42, or 43 of the C-terminally-extended analog. In certain embodiments, the acylated or alkylated amino acid is located at position 40 of the C-terminally extended analog.

In some embodiments, the analog having GIP agonist activity further comprises amino acid modifications at one, two or all of positions 27, 28 and 29, e.g., amino acid modifications at position 27 and/or 28.

In any of the above exemplary embodiments, the amino acid modification at position 1 that confers GIP agonist activity can be a substitution of His with an amino acid lacking an imidazole side chain. The amino acid modification at position 1 can, for example, be a substitution of His with a large, aromatic amino acid. In some embodiments, the large, aromatic amino acid is any of those described herein, including, for example, Tyr.

Also, with regard to the above exemplary embodiments, amino acid modifications at one, two, or all of positions 27, 28, and 29 can be any of the modifications at these positions described herein. For example, the Met at position 27 can be substituted with a large aliphatic amino acid, optionally Leu, the Asn at position 28 can be substituted with a small aliphatic amino acid, optionally Ala, and/or the Thr at position 29 can be substituted with a small aliphatic amino acid, optionally Gly. Alternatively, the analog can comprise such amino acid modifications at position 27 and/or 28.

The analog of the above exemplary embodiments can further comprise 1-9 or 1-6 further, additional amino acid modifications, e.g. 1, 2, 3, 4, 5, 6, 7, 8 or 9 further amino acid modifications, such as, for example, any of the modifications described herein which increase or decrease the activity at any of the GIP, GLP-1, and glucagon receptors, improve solubility, improve duration of action or half-life in circulation, delay the onset of action, or increase stability. The analog can further comprise, for example, an amino acid modification at position 12, optionally, a substitution with Ile, and/or amino acid modifications at positions 17 and 18, optionally substitution with Q at position 17 and A at position 18, and/or an addition of GPSSGAPPPS (SEQ ID NO: 1095) or XGPSSGAPPPS (SEQ ID NO: 1096), or sequences containing one or more conservative substitutions relative to SEQ ID NO: 1095 or 1096, to the C-terminus. The analog can comprise one or more of the following modifications:
  (i) Ser at position 2 substituted with D-Ser, Ala, D-Ala, Gly, N-methyl-Ser, AIB, Val, or α-amino-N-butyric acid;
  (ii) Tyr at position 10 substituted with Trp, Lys, Orn, Glu, Phe, or Val;
  (iii) Linkage of an acyl group to a Lys at position 10;
  (iv) Lys at position 12 substituted with Arg;
  (v) Ser at position 16 substituted with Glu, Gln, homoglutamic acid, homocysteic acid, Thr, Gly, or AIB;
  (vi) Arg at position 17 substituted with Gln;
  (vii) Arg at position 18 substituted with Ala, Ser, Thr, or Gly;
  (viii) Gln at position 20 substituted with Ala, Ser, Thr, Lys, Citrulline, Arg, Orn, or AIB;
  (ix) Asp at position 21 substituted with Glu, homoglutamic acid, homocysteic acid;
  (x) Val at position 23 substituted with Ile;
  (xi) Gln at position 24 substituted with Asn, Ala, Ser, Thr, or AIB; and
  (xii) a conservative substitution at any of positions 2, 5, 9, 10, 11, 12, 13, 14, 15, 16, 17, 18, 19, 20, 21, 24, 27, 28, and 29.

The analog in some embodiments comprise a combination of the modifications (i) through (xii). Alternatively or additionally, the analog can comprise an amino acid modification at position 3 (e.g., an amino acid substitution of Gln with Glu), wherein the analog has less than 1% of the activity of glucagon at the glucagon receptor. Alternatively or additionally, the analog can comprise an amino acid modification at position 7 (e.g., an amino acid substitution of Thr with an amino acid lacking a hydroxyl group, e.g., Abu or Ile), wherein the analog has less than about 10% of the activity of GLP-1 at the GLP-1 receptor.

With regard to the exemplary embodiments, the analog can be covalently linked to a hydrophilic moiety. In some embodiments, the analog is covalently linked to the hydrophilic moiety at any of amino acid positions 16, 17, 20, 21, 24, 29, 40, or the C-terminus. In certain embodiments, the analog comprises a C-terminal extension (e.g., an amino acid sequence of SEQ ID NO: 1095) and an addition of an amino acid comprising the hydrophilic moiety, such that the hydrophilic moiety is covalently linked to the analog at position 40.

In still further exemplary embodiments, the analog of glucagon having GIP agonist activity comprises the amino acid sequence according to any one of SEQ ID NOs: 1227, 1228, 1229 or 1230 that further comprises the following modifications:
  (a) optionally, an amino acid modification at position 1 that confers GIP agonist activity,
  (b) an extension of about 1 to about 21 amino acids C-terminal to the amino acid at position 29, wherein at least one of the amino acids of the extension is acylated or alkylated, and
  (d) up to 6 further amino acid modifications,
wherein the EC50 of the analog for GIP receptor activation is about 10 nM or less. In some aspects, the acylated or alkylated amino acid is an amino acid of Formula I, II, or III. In more specific embodiments, the amino acid of Formula I is Dab, Orn, Lys, or homoLys. Also, in some embodiments, the about 1 to about 21 amino acids comprises the amino acid sequence of GPSSGAPPPS (SEQ ID NO: 1095) or XGPSSGAPPPS (SEQ ID NO: 1096), wherein X is any amino acid, or GPSSGAPPPK (SEQ ID NO: 1170) or XGPSSGAPPPK (SEQ ID NO: 1171) or XGPSSGAPPPSK (SEQ ID NO: 1172), wherein X is Gly or a small, aliphatic or non-polar or slightly polar amino acid. In some embodiments, the about 1 to about 21 amino acids may comprise sequences containing one or more conservative substitutions relative to SEQ ID NO: 1095, 1096, 1170, 1171 or 1172. In some embodiments, the acylated or alkylated amino acid is located at position 37, 38, 39, 40, 41, 42, or 43 of the C-terminally-extended analog. In certain embodiments, the acylated or alkylated amino acid is located at position 40 of the C-terminally extended analog. In any of the above exemplary embodiments, the amino acid at position 1 that confers GIP agonist activity can be an amino acid lacking an imidazole side chain.

The analog of the above exemplary embodiments can further comprise 1-6 further amino acid modifications, such as, for example, any of the modifications described herein which increase or decrease the activity at any of the GIP, GLP-1, and glucagon receptors, improve solubility, improve duration of action or half-life in circulation, delay the onset of action, or increase stability.

In certain aspects, glucagon analogs described in the above exemplary embodiment, comprise further amino acid modifications at one, two or all of positions 27, 28 and 29. Modifications at these positions can be any of the modifications described herein relative to these positions. For example, relative to SEQ ID NO: 1227, 1228, 1229 or 1230, position 27 can be substituted with a large aliphatic amino acid (e.g., Leu, Ile or norleucine) or Met, position 28 can be substituted with another small aliphatic amino acid (e.g., Gly or Ala) or Asn, and/or position 29 can be substituted with another small aliphatic amino acid (e.g., Ala or Gly) or Thr. Alternatively, the analog can comprise such amino acid modifications at position 27 and/or 28.

The analog can further comprise one or more of the following additional modifications:
  (i) the amino acid at position 2 is any one of D-Ser, Ala, D-Ala, Gly, N-methyl-Ser, AIB, Val, or α-amino-N-butyric acid;
  (ii) the amino acid at position 10 is Tyr, Trp, Lys, Orn, Glu, Phe, or Val;
  (iii) linkage of an acyl group to a Lys at position 10;
  (iv) the amino acid at position 12 is Ile, Lys or Arg;
  (v) the amino acid at position 16 is any one of Ser, Glu, Gln, homoglutamic acid, homocysteic acid, Thr, Gly, or AIB;
  (vi) the amino acid at position 17 is Gln or Arg;
  (vii) the amino acid at position 18 is any one of Ala, Arg, Ser, Thr, or Gly;
  (viii) the amino acid at position 20 is any one of Ala, Ser, Thr, Lys, Citrulline, Arg, Orn, or AIB or another alpha, alpha-disubstituted amino acid;
  (ix) the amino acid at position 21 is any one of Glu, Asp, homoglutamic acid, homocysteic acid;
  (x) the amino acid at position 23 is Val or Ile;
  (xi) the amino acid at position 24 is any one of Gln, Asn, Ala, Ser, Thr, or AIB; and
  (xii) one or more conservative substitutions at any of positions 2, 5, 9, 10, 11, 12, 13, 14, 15, 16, 17, 18, 19, 20, 21, 24, 27, 28, and 29.

The analog in some embodiments comprise a combination of the modifications (i) through (xii). Alternatively or additionally, the analog can comprise an amino acid modification at position 3 (e.g., an amino acid substitution of Gln with Glu), wherein the analog has less than 1% of the activity of glucagon at the glucagon receptor. Alternatively or additionally, the analog can comprise an amino acid modification at position 7 (e.g., an amino acid substitution of Thr with an amino acid lacking a hydroxyl group, e.g., Abu or Ile), wherein the analog has less than about 10% of the activity of GLP-1 at the GLP-1 receptor.

In the above exemplary embodiments, wherein the analog comprises an acyl or alkyl group, the analog may be attached to the acyl or alkyl group via a spacer, as described herein. The spacer, for example, may be 3 to 10 atoms in length and may be, for instance, an amino acid (e.g., 6-amino hexanoic acid, any amino acid described herein), a dipeptide (e.g., Ala-Ala, βAla-βAla, Leu-Leu, Pro-Pro, γGlu-γGlu), a tripeptide, or a hydrophilic or hydrophobic bifunctional spacer. In certain aspects, the total length of the spacer and the acyl or alkyl group is about 14 to about 28 atoms. In some embodiments, the amino acid spacer is not γ-Glu. In some embodiments, the dipeptide spacer is not γ-Glu-γ-Glu.

In some very specific embodiments, an analog of the invention comprises an amino acid sequence selected from the group consisting of SEQ ID NOs: 1099-1141, 1144-1164, 1166, 1192-1207, 1209-1221 and 1223 or selected from the group consisting of SEQ ID NOs: 1167-1169, 1173-1178 and 1225.

In still further exemplary embodiments, the analog of glucagon having GIP agonist activity comprises an acyl or alkyl group (e.g., an acyl or alkyl group which is non-native to a naturally occurring amino acid), wherein the acyl or alkyl group is attached to a spacer, wherein (i) the spacer is attached to the side chain of the amino acid at position 10 of the analog; or (ii) the analog comprises an extension of 1 to 21 amino acids C-terminal to the amino acid at position 29 and the spacer is attached to the side chain of an amino acid corresponding to one of positions 37-43 relative to SEQ ID NO: 1001, wherein the EC50 of the analog for GIP receptor activation is about 10 nM or less.

In such embodiments, the analog may comprise an amino acid sequence of SEQ ID NO: 1001 with (i) an amino acid modification at position 1 that confers GIP agonist activity, (ii) amino acid modifications at one, two, or all of positions 27, 28, and 29, (iii) at least one of:
  (A) the analog comprises a lactam bridge between the side chains of amino acids at positions i and i+4 or between the side chains of amino acids at positions j and j+3, wherein i is 12, 13, 16, 17, 20 or 24, and wherein j is 17;

(B) one, two, three, or all of the amino acids at positions 16, 20, 21, and 24 of the analog is substituted with an α,α-disubstituted amino acid; or (C) the analog comprises (i) an amino acid substitution of Ser at position 16 with an amino acid of Formula IV:

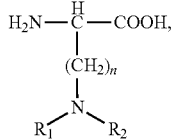

[Formula IV]

wherein n is 1 to 7, wherein each of R1 and R2 is independently selected from the group consisting of H, $C_1$-$C_{18}$ alkyl, ($C_1$-$C_{18}$ alkyl)OH, ($C_1$-$C_{18}$ alkyl)NH$_2$, ($C_1$-$C_{18}$ alkyl)SH, ($C_0$-$C_4$ alkyl)($C_3$-$C_6$)cycloalkyl, ($C_0$-$C_4$ alkyl)($C_2$-$C_5$ heterocyclic), ($C_0$-$C_4$ alkyl)($C_6$-$C_{10}$ aryl)$R_7$, and ($C_1$-$C_4$ alkyl) ($C_3$-$C_9$ heteroaryl), wherein $R_7$ is H or OH, and the side chain of the amino acid of Formula IV comprises a free amino group; and (ii) an amino acid substitution of the Gln at position 20 with an alpha, alpha-disubstituted amino acid, and (iv) up to 6 further amino acid modifications.

The alpha, alpha-disubstituted amino acid of the analog of these embodiments may be any alpha, alpha-disubstituted amino acid, including, but not limited to, aminoisobutyric acid (AIB), an amino acid disubstituted with the same or a different group selected from methyl, ethyl, propyl, and n-butyl, or with a cyclooctane or cycloheptane (e.g., 1-aminocyclooctane-1-carboxylic acid). In certain embodiments, the alpha, alpha-disubstituted amino acid is AIB.

The amino acid of Formula IV of the analog of these embodiments may be any amino acid, such as, for example, the amino acid of Formula IV, wherein n is 1, 2, 3, 4, 5, 6, 7, 8, 9, 10, 11, 12, 13, 14, 15, or 16. In certain embodiments, n is 2, 3, 4, or 5, in which case, the amino acid is Dab, Orn, Lys, or homoLys respectively. In any of the above exemplary embodiments, the amino acid modification at position 1 that confers GIP agonist activity can be a substitution of His with an amino acid lacking an imidazole side chain.

Also, with regard to the above exemplary embodiments, amino acid modifications at one, two, or all of positions 27, 28, and 29 can be any of the modifications at these positions described herein. For example, the Met at position 27 can be substituted with a large aliphatic amino acid, optionally Leu, the Asn at position 28 can be substituted with a small aliphatic amino acid, optionally Ala, and/or the Thr at position 29 can be substituted with a small aliphatic amino acid, optionally Gly. Alternatively, the analog can comprise such amino acid modifications at position 27 and/or 28.

The analog can further comprise, for example, an amino acid modification at position 12, optionally, a substitution with Ile, and/or amino acid modifications at positions 17 and 18, optionally substitution with Q at position 17 and A at position 18, and/or an addition of GPSSGAPPPS (SEQ ID NO: 1095) or XGPSSGAPPPS (SEQ ID NO: 1096), or sequences containing one or more conservative substitutions relative to SEQ ID NO: 1095 or 1096, to the C-terminus. The analog can comprise one or more of the following modifications:

(i) Ser at position 2 substituted with D-Ser, Ala, D-Ala, Gly, N-methyl-Ser, AIB, Val, or α-amino-N-butyric acid;

(ii) Tyr at position 10 substituted with Trp, Lys, Orn, Glu, Phe, or Val;

(iii) Linkage of an acyl group to a Lys at position 10;

(iv) Lys at position 12 substituted with Arg;

(v) Ser at position 16 substituted with Glu, Gln, homoglutamic acid, homocysteic acid, Thr, Gly, Lys, or AIB;

(vi) Arg at position 17 substituted with Gln;

(vii) Arg at position 18 substituted with Ala, Ser, Thr, or Gly;

(viii) Gln at position 20 substituted with Ala, Ser, Thr, Lys, Citrulline, Arg, Orn, or AIB;

(ix) Asp at position 21 substituted with Glu, homoglutamic acid, homocysteic acid;

(x) Val at position 23 substituted with Ile;

(xi) Gln at position 24 substituted with Asn, Ala, Ser, Thr, or AIB; and (xii) a conservative substitution at any of positions 2, 5, 9, 10, 11, 12, 13, 14, 15, 16, 17, 18, 19, 20, 21, 24, 27, 28, and 29.

The analog in some embodiments comprise a combination of the modifications (i) through (xii). Alternatively or additionally, the analog can comprise an amino acid modification at position 3 (e.g., an amino acid substitution of Gln with Glu), wherein the analog has less than 1% of the activity of glucagon at the glucagon receptor. Alternatively or additionally, the analog can comprise an amino acid modification at position 7 (e.g., an amino acid substitution of Thr with an amino acid lacking a hydroxyl group, e.g., Abu or Ile), a deletion of the amino acid(s) C-terminal to the amino acid at position 27 or 28, yielding a 27- or 28-amino acid peptide, or a combination thereof, wherein the analog has less than about 10% of the activity of GLP-1 at the GLP-1 receptor.

With regard to the exemplary embodiments, the analog can be covalently linked to a hydrophilic moiety. In some embodiments, the analog is covalently linked to the hydrophilic moiety at any of amino acid positions 16, 17, 20, 21, 24, 29, 40, or the C-terminus. In certain embodiments, the analog comprises a C-terminal extension (e.g., an amino acid sequence of SEQ ID NO: 1095) and an addition of an amino acid comprising the hydrophilic moiety, such that the hydrophilic moiety is covalently linked to the analog at position 40.

In some embodiments, the hydrophilic moiety is covalently linked to a Lys, Cys, Orn, homocysteine, or acetylphenylalanine of the analog. The Lys, Cys, Orn, homocysteine, or acetyl-phenylalanine may be an amino acid that is native to the glucagon sequence (SEQ ID NO: 1001) or it may be an amino acid which is replacing a native amino acid of SEQ ID NO: 1001. In some embodiments, wherein the hydrophilic moiety is attached to a Cys, the linkage to the hydrophilic moiety can comprise the structure

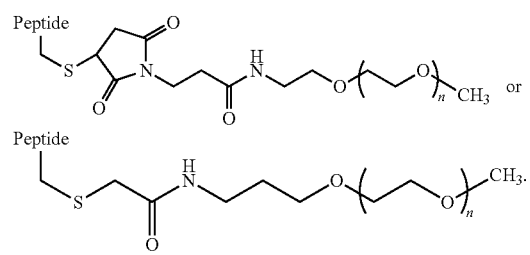

With regard to the analogs comprising a hydrophilic moiety, the hydrophilic moiety may be any of those described herein. See, e.g., the teachings under the section "Linkage of hydrophilic moieties." In some embodiments, the hydrophilic moiety is a polyethylene glycol (PEG). The PEG in certain embodiments has a molecular weight of about 1,000 Daltons to about 40,000 Daltons, e.g., about 20,000 Daltons to about 40,000 Daltons.

In the exemplary embodiments, wherein the analog comprises an acyl or alkyl group, which is attached to the analog via a spacer, the spacer can be any spacer as described herein. The spacer, for example, may be 3 to 10 atoms in length and may be, for instance, an amino acid (e.g., 6-amino hexanoic acid, any amino acid described herein), a dipeptide (e.g., Ala-Ala, βAla-βAla, Leu-Leu, Pro-Pro, γGlu-γGlu), a tripeptide, or a hydrophilic or hydrophobic bifunctional spacer. In certain aspects, the total length of the spacer and the acyl or alkyl group is about 14 to about 28 atoms. In some embodiments, the amino acid spacer is not γ-Glu. In some embodiments, the dipeptide spacer is not γ-Glu-γ-Glu.

The acyl or alkyl group is any acyl or alkyl group as described herein, such as an acyl or alkyl group which is non-native to a naturally occurring amino acid. The acyl or alkyl group in some embodiments is a C4 to C30 fatty acyl group, such as, for example, a C10 fatty acyl or alkyl group, a C12 fatty acyl or alkyl group, a C14 fatty acyl or alkyl group, a C16 fatty acyl or alkyl group, a C18 fatty acyl or alkyl group, a C20 acyl or alkyl group, or a C22 acyl or alkyl group, or a C4 to C30 alkyl group. In specific embodiments, the acyl group is a C12 to C18 fatty acyl group (e.g., a C14 or C16 fatty acyl group).

In some embodiments, the extension of about 1 to about 21 amino acids C-terminal to the amino acid at position 29 of the analog comprises the amino acid sequence of GPSSGAPPPS (SEQ ID NO: 1095) or XGPSSGAPPPS (SEQ ID NO: 1096), wherein X is any amino acid, or GPSSGAPPPK (SEQ ID NO: 1170) or XGPSSGAPPPK (SEQ ID NO: 1171) or XGPSSGAPPPSK (SEQ ID NO: 1172), wherein X is Gly or a small, aliphatic or non-polar or slightly polar amino acid. In some embodiments, the about 1 to about 21 amino acids may comprise sequences containing one or more conservative substitutions relative to SEQ ID NO: 1095, 1096, 1170, 1171 or 1172. In some embodiments, the acylated or alkylated amino acid is located at position 37, 38, 39, 40, 41, 42, or 43 of the C-terminally-extended analog. In certain embodiments, the acylated or alkylated amino acid is located at position 40 of the C-terminally extended analog. In certain embodiments, the acyl or alkyl group is covalently linked to an amino acid which is native to SEQ ID NO: 1001, 1227, 1228, 1229 or 1230 or it may be linked to a substituted amino acid. In certain embodiments, the acyl or alkyl group is covalently linked to an amino acid which is native to SEQ ID NO: 1095, 1096, 1171 or 1172.

The GIP agonist may be a peptide comprising the amino acid sequence of any of the amino acid sequences, e.g., SEQ ID NOs: 1005-1094, optionally with up to 1, 2, 3, 4, or 5 further modifications that retain GIP agonist activity. In certain embodiments, the GIP agonist comprises the amino acids of any of SEQ ID NOs: 1099-1262.

Class 3 Glucagon Related Peptides

In certain embodiments, the glucagon related peptide is a Class 3 glucagon related peptide, which is described herein and in International Patent Application No. PCT/US2009/47438 (filed on Jun. 16, 2009), International Patent Application Publication No. WO 2008/101017, published on Aug. 21, 2008, and U.S. Provisional Application No. 61/090,412 and U.S. Application No. 61/177,476, the contents of which are incorporated by reference in their entirety.

Some of the biological sequences referenced in the following section (SEQ ID NOs: 89-108, 114-128 and 146-656) relating to Class 3 glucagon related peptides correspond to SEQ ID NOs: 89-108, 114-128 and 146-656 in International Patent Application No. PCT/US2009/47438.

Activity

The Class 3 glucagon related peptide can be a peptide that exhibits increased activity at the glucagon receptor, and in further embodiments exhibits enhanced biophysical stability and/or aqueous solubility. In addition, in some embodiments, the Class 3 glucagon related peptide has lost native glucagon's selectivity for the glucagon receptor verses the GLP-1 receptor, and thus represents co-agonists of those two receptors. Selected amino acid modifications within the Class 3 glucagon related peptide can control the relative activity of the peptide at the GLP-1 receptor verses the glucagon receptor. Thus, the Class 3 glucagon related peptide can be a glucagon/GLP-1 co-agonist that has higher activity at the glucagon receptor versus the GLP-1 receptor, a glucagon/GLP-1 co-agonist that has approximately equivalent activity at both receptors, or a glucagon/GLP-1 co-agonist that has higher activity at the GLP-1 receptor versus the glucagon receptor. The latter category of co-agonist can be engineered to exhibit little or no activity at the glucagon receptor, and yet retain ability to activate the GLP-1 receptor with the same or better potency than native GLP-1. Any of these co-agonists may also include modifications that confer enhanced biophysical stability and/or aqueous solubility.

Modifications of the Class 3 glucagon related peptide can be made to produce a glucagon related peptide having anywhere from at least about 1% (including at least about 1.5%, 2%, 5%, 7%, 10%, 20%, 30%, 40%, 50%, 60%, 75%, 100%, 125%, 150%, 175%) to about 200% or higher activity at the GLP-1 receptor relative to native GLP-1 and anywhere from at least about 1% (including about 1.5%, 2%, 5%, 7%, 10%, 20%, 30%, 40%, 50%, 60%, 75%, 100%, 125%, 150%, 175%, 200%, 250%, 300%, 350%, 400%, 450%) to about 500% or higher activity at the glucagon receptor relative to native glucagon. The amino acid sequence of native glucagon is SEQ ID NO: 701, the amino acid sequence of GLP-1(7-36)amide is SEQ ID NO: 703, and the amino acid sequence of GLP-1(7-37)acid is SEQ ID NO: 704.

The Class 3 glucagon related peptide can be a glucagon related peptide with increased or decreased activity at the glucagon receptor, or GLP-1 receptor, or both. The Class 3 glucagon related peptide can be a glucagon related peptide with altered selectivity for the glucagon receptor versus the GLP-1 receptor. As disclosed herein high potency Class 3 glucagon related peptides are provided that also exhibit improved solubility and/or stability.

Modifications Affecting Glucagon Activity

Increased activity at the glucagon receptor is provided by an amino acid modification at position 16 of native glucagon (SEQ ID NO: 701). In some embodiments, the Class 3 glucagon related peptide is a glucagon agonist that has been modified relative to the wild type peptide of His-Ser-Gln-Gly-Thr-Phe-Thr-Ser-Asp-Tyr-Ser-Lys-Tyr-Leu-Asp-Ser-Arg-Arg-Ala-Gln-Asp-Phe-Val-Gln-Trp-Leu-Met-Asn-Thr (SEQ ID NO: 701) to enhance the peptide's potency at the glucagon receptor. The normally occurring serine at position 16 of native glucagon (SEQ ID NO: 701) can be substituted with select acidic amino acids to enhance the potency of glucagon, in terms of its ability to stimulate cAMP synthesis in a validated in vitro model assay (see Example 7). More particularly, this substitution enhances the potency of the analog at least 2-fold, 4-fold, 5-fold, and up to 10-fold greater at the glucagon receptor. This substitution also enhances the analog's activity at the GLP-1 receptor at least 5-fold, 10-fold, or 15-fold relative to native glucagon, but selectivity is maintained for the glucagon receptor over the GLP-1 receptor.

By way of nonlimiting example, such enhanced potency can be provided by substituting the naturally occurring serine at position 16 with glutamic acid or with another negatively charged amino acid having a side chain with a length of 4 atoms, or alternatively with any one of glutamine, homoglutamic acid, or homocysteic acid, or a charged amino acid having a side chain containing at least one heteroatom, (e.g. N, O, S, P) and with a side chain length of about 4 (or 3-5) atoms. In accordance with some embodiments, the serine residue at position 16 of native glucagon is substituted with an amino acid selected from the group consisting of glutamic acid, glutamine, homoglutamic acid, homocysteic acid, threonine, or glycine. In accordance with some embodiments, the serine residue at position 16 of native glucagon is substituted with an amino acid selected from the group consisting of glutamic acid, glutamine, homoglutamic acid and homocysteic acid, and in some embodiments the serine residue is substituted with glutamic acid.

In some embodiments, the enhanced potency Class 3 glucagon related peptide comprises a peptide of SEQ ID NO: 90, SEQ ID NO: 91, SEQ ID NO: 92, SEQ ID NO: 93, SEQ ID NO: 94, SEQ ID NO: 95 or a glucagon agonist analog of SEQ ID NO: 93. In accordance with some embodiments, a Class 3 glucagon related peptide having enhanced potency at the glucagon receptor relative to wild type glucagon is provided wherein the peptide comprises the sequence of SEQ ID NO: 95, SEQ ID NO: 96, SEQ ID NO: 97 or SEQ ID NO: 98, wherein the glucagon related peptide retains its selectivity for the glucagon receptor relative to the GLP-1 receptors. In some embodiments, the Class 3 glucagon related peptide having enhanced specificity for the glucagon receptor comprises the peptide of SEQ ID NO: 96, SEQ ID NO: 97, SEQ ID NO: 98 or a glucagon agonist analog thereof, wherein the carboxy terminal amino acid retains its native carboxylic acid group. In accordance with some embodiments, a Class 3 glucagon related peptide comprises the sequence of NH2-His-Ser-Gln-Gly-Thr-Phe-Thr-Ser-Asp-Tyr-Ser-Lys-Tyr-Leu-Asp-Glu-Arg-Arg-Ala-Gln-Asp-Phe-Val-Gln-Trp-Leu-Met-Asn-Thr-COOH (SEQ ID NO: 98), wherein the peptide exhibits approximately fivefold enhanced potency at the glucagon receptor, relative to native glucagon as measured by the in vitro cAMP assay of Example 7.

Glucagon receptor activity can be reduced, maintained, or enhanced by an amino acid modification at position 3, e.g. substitution of the naturally occurring glutamine at position 3. In some embodiments, substitution of the amino acid at position 3 with an acidic, basic, or hydrophobic amino acid (glutamic acid, ornithine, norleucine) has been shown to substantially reduce or destroy glucagon receptor activity. The analogs that are substituted with, for example, glutamic acid, ornithine, or norleucine have about 10% or less of the activity of native glucagon at the glucagon receptor, e.g. about 1-10%, or about 0.1-10%, or greater than about 0.1% but less than about 10%, while exhibiting at least 20% of the activity of GLP-1 at the GLP-1 receptor. For example, exemplary analogs described herein have about 0.5%, about 1% or about 7% of the activity of native glucagon, while exhibiting at least 20% of the activity of GLP-1 at the GLP-1 receptor. In particular, any of the Class 3 glucagon related peptides, including glucagon analogs, glucagon agonist analogs, glucagon co-agonists, and glucagon/GLP-1 co-agonist molecules, described herein may be modified to contain a modification at position 3, e.g., Gln substituted with Glu, to produce a peptide with high selectivity, e.g., tenfold selectivity, for the GLP-1 receptor as compared to the selectivity for the glucagon receptor.

In another embodiment, the naturally occurring glutamine at position 3 of any of the Class 3 glucagon related peptides can be substituted with a glutamine analog without a substantial loss of activity at the glucagon receptor, and in some cases, with an enhancement of glucagon receptor activity, as described herein. In specific embodiments, the amino acid at position 3 is substituted with Dab(Ac). For example, glucagon agonists can comprise the amino acid sequence of SEQ ID NO: 595, SEQ ID NO: 601 SEQ ID NO: 603, SEQ ID NO: 604, SEQ ID NO: 605, and SEQ ID NO: 606.

It was observed that modifications at position 2 (e.g. AIB at position 2) and in some cases modifications at position 1 may reduce glucagon activity. This reduction in glucagon activity can be restored by stabilizing the alpha-helix in the C-terminal portion of glucagon, e.g. through means described herein, for example, through a covalent bond between the side chains of the amino acids at positions "i" and "i+4", e.g., 12 and 16, 16 and 20, or 20 and 24. In some embodiments, this covalent bond is a lactam bridge between a glutamic acid at position 16 and a lysine at position 20. In some embodiments, this covalent bond is an intramolecular bridge other than a lactam bridge. For example, suitable covalent bonding methods include any one or more of olefin metathesis, lanthionine-based cyclization, disulfide bridge or modified sulfur-containing bridge formation, the use of α,ω-diaminoalkane tethers, the formation of metal-atom bridges, and other means of peptide cyclization.

Modifications Affecting GLP-1 Activity

Enhanced activity at the GLP-1 receptor is provided by replacing the carboxylic acid of the C-terminal amino acid with a charge-neutral group, such as an amide or ester. In some embodiments, these Class 3 glucagon related peptides comprise a sequence of SEQ ID NO: 108, wherein the carboxy terminal amino acid has an amide group in place of the carboxylic acid group found on the native amino acid. These Class 3 glucagon related peptides have strong activity at both the glucagon and GLP-1 receptors and thus act as co-agonists at both receptors. In accordance with some embodiments, the Class 3 glucagon related peptide is a glucagon and GLP-1 receptor co-agonist, wherein the peptide comprises the sequence of SEQ ID NO: 108, wherein the amino acid at position 28 is Asn or Lys and the amino acid at position 29 is Thr-amide.

Increased activity at the GLP-1 receptor is provided by modifications that stabilize the alpha helix in the C-terminal portion of glucagon (e.g. around residues 12-29). In some embodiments, such modifications permit formation of an intramolecular bridge between the side chains of two amino acids that are separated by three intervening amino acids (i.e., an amino acid at position "i" and an amino acid at position "i+4", wherein i is any integer between 12 and 25), by two intervening amino acids, i.e., an amino acid at position "j" and an amino acid at position "j+3," wherein j is any integer between 12 and 27, or by six intervening amino acids, i.e., an amino acid at position "k" and an amino acid at position "k+7," wherein k is any integer between 12 and 22. In exemplary embodiments, the bridge or linker is about 8 (or about 7-9) atoms in length and forms between side chains of amino acids at positions 12 and 16, or at positions 16 and 20, or at positions 20 and 24, or at positions 24 and 28. The two amino acid side chains can be linked to one another through non-covalent bonds, e.g., hydrogen-bonding, ionic interactions, such as the formation of salt bridges, or by covalent bonds.

In accordance with some embodiments, the Class 3 glucagon related peptide exhibits glucagon/GLP-1 receptor co-agonist activity and comprises an amino acid sequence selected from the group consisting of SEQ ID NO: 99, 101, 102 and 103. In some embodiments, the side chains are covalently bound to one another, and in some embodiments the two amino acids are bound to one another to form a lactam ring.

In some embodiments, the Class 3 glucagon related peptide comprises a glucagon related peptide analog of SEQ ID NO: 108, wherein the peptide comprises an intramolecular lactam bridge formed between amino acid positions 12 and 16 or between amino acid positions 16 and 20. In some embodiments, the Class 3 glucagon related peptide comprises the sequence of SEQ ID NO: 108, wherein an intramolecular lactam bridge is formed between amino acid positions 12 and 16, between amino acid positions 16 and 20, or between amino acid positions 20 and 24 and the amino acid at position 29 is glycine, wherein the sequence of SEQ ID NO: 29 is linked to the C-terminal amino acid of SEQ ID NO: 108. In a further embodiment, the amino acid at position 28 is aspartic acid.

In some specific embodiments, stabilization of the alpha helix structure in the C-terminal portion of the Class 3 glucagon related peptide is achieved through the formation of an intramolecular bridge other than a lactam bridge. For example, suitable covalent bonding methods include any one or more of olefin metathesis, lanthionine-based cyclization, disulfide bridge or modified sulfur-containing bridge formation, the use of α, ω-diaminoalkane tethers, the formation of metal-atom bridges, and other means of peptide cyclization are used to stabilize the alpha helix.

Furthermore, enhanced activity at the GLP-1 receptor may be achieved by stabilizing the alpha-helix structure in the C-terminal portion of the glucagon related peptide (around amino acids 12-29) through purposeful introduction of one or more α,α-disubstituted amino acids at positions that retain the desired activity. Such peptides may be considered herein as a peptide lacking an intramolecular bridge. In some aspects, stabilization of the alpha-helix is accomplished in this manner without introduction of an intramolecular bridge such as a salt bridge or covalent bond. In some embodiments, one, two, three, four or more of positions 16, 17, 18, 19, 20, 21, 24 or 29 of a glucagon related peptide is substituted with an α,α-disubstituted amino acid. For example, substitution of position 16 of the Class 3 glucagon related peptide with aminoisobutyric acid (AIB) enhances GLP-1 activity, in the absence of a salt bridge or lactam. In some embodiments, one, two, three or more of positions 16, 20, 21 or 24 are substituted with AIB.

Enhanced activity at the GLP-1 receptor may be achieved by an amino acid modification at position 20. In some embodiments, the glutamine at position 20 is replaced with another hydrophilic amino acid having a side chain that is either charged or has an ability to hydrogen-bond, and is at least about 5 (or about 4-6) atoms in length, for example, lysine, citrulline, arginine, or ornithine.

Increased activity at the GLP-1 receptor is demonstrated in Class 3 glucagon related peptides comprising the C-terminal extension of SEQ ID NO: 78. GLP-1 activity in such Class 3 glucagon related peptides comprising SEQ ID NO: 78 can be further increased by modifying the amino acid at position 18, 28 or 29, or at position 18 and 29, as described herein. A further modest increase in GLP-1 potency may be achieved by modifying the amino acid at position 10 to be Trp.

Combinations of the modifications that increase GLP-1 receptor activity may provide higher GLP-1 activity than any of such modifications taken alone. For example, the Class 3 glucagon related peptides can comprise modifications at position 16, at position 20, and at the C-terminal carboxylic acid group, optionally with a covalent bond between the amino acids at positions 16 and 20; can comprise modifications at position 16 and at the C-terminal carboxylic acid group; can comprise modifications at positions 16 and 20, optionally with a covalent bond between the amino acids at positions 16 and 20; or can comprise modifications at position 20 and at the C-terminal carboxylic acid group; optionally with the proviso that the amino acid at position 12 is not Arg; or optionally with the proviso that the amino acid at position 9 is not Glu.

Modifications Affecting Solubility
Addition of Hydrophilic Moieties

The Class 3 glucagon related peptides can be further modified to improve the peptide's solubility and stability in aqueous solutions at physiological pH, while retaining the high biological activity relative to native glucagon. Hydrophilic moieties as discussed herein can be attached to the Class 3 glucagon related peptide as further discussed herein. In accordance with some embodiments, introduction of hydrophilic groups at positions 17, 21, and 24 of the Class 3 glucagon related peptide comprising SEQ ID NO: 97 or SEQ ID NO: 98 are anticipated to improve the solubility and stability of the high potency glucagon analog in solutions having a physiological pH. Introduction of such groups also increases duration of action, e.g. as measured by a prolonged half-life in circulation.

In some embodiments, the Class 3 glucagon related peptide comprises a sequence selected from the group consisting of SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106 and SEQ ID NO: 107, wherein the side chain of an amino acid residue at one of position 16, 17, 21 or 24 of said Class 3 glucagon related peptide further comprises a polyethylene glycol chain, having a molecular weight selected from the range of about 500 to about 40,000 Daltons. In some embodiments, the polyethylene glycol chain has a molecular weight selected from the range of about 500 to about 5,000 Daltons. In another embodiment. the polyethylene glycol chain has a molecular weight of about 10,000 to about 20,000 Daltons. In yet other exemplary embodiments the polyethylene glycol chain has a molecular weight of about 20,000 to about 40,000 Daltons. In accordance with some embodiments the hydrophilic group comprises a polyethylene glycol (PEG) chain. More particularly, in some embodiments, the Class 3 glucagon related peptide comprises the sequence of SEQ ID NO: 94 or SEQ ID NO: 95 wherein a PEG chain is covalently linked to the side chains of amino acids present at positions 21 and 24 of the Class 3 glucagon related peptide and the carboxy terminal amino acid of the Class 3 glucagon related peptide has the carboxylic acid group. In accordance with some embodiments, the polyethylene glycol chain has an average molecular weight selected from the range of about 500 to about 10,000 Daltons.

In accordance with some embodiments, the pegylated Class 3 glucagon related peptide comprises two or more polyethylene glycol chains covalently bound to the Class 3 glucagon related peptide wherein the total molecular weight of the glucagon chains is about 1,000 to about 5,000

Daltons. In some embodiments the pegylated glucagon agonist comprises a peptide consisting of SEQ ID NO: 93 or a glucagon agonist analog of SEQ ID NO: 93, wherein a PEG chain is covalently linked to the amino acid residue at position 21 and at position 24, and wherein the combined molecular weight of the two PEG chains is about 1,000 to about 5,000 Daltons.

Charged C-terminus

The solubility of the Class 3 glucagon related peptide comprising SEQ ID NO: 20 can be further improved, for example, by introducing one, two, three or more charged amino acid(s) to the C-terminal portion of glucagon related peptide of SEQ ID NO: 108, preferably at a position C-terminal to position 27. Such a charged amino acid can be introduced by substituting a native amino acid with a charged amino acid, e.g. at positions 28 or 29, or alternatively by adding a charged amino acid, e.g. after position 27, 28 or 29. In exemplary embodiments, one, two, three or all of the charged amino acids are negatively charged. Additional modifications, e.g. conservative substitutions, may be made to the Class 3 glucagon related peptide that still allow it to retain glucagon activity. In some embodiments, an analog of the Class 3 glucagon related peptide of SEQ ID NO: 108 is provided wherein the analog differs from SEQ ID NO: 108 by 1 to 2 amino acid substitutions at positions 17-26, and, in some embodiments, the analog differs from the peptide of SEQ ID NO: 108 by an amino acid substitution at position 20.

Acylation/Alkylation

In accordance with some embodiments, the glucagon related peptide is modified to comprise an acyl or alkyl group, e.g., a C4 to C30 acyl or alkyl group. In some embodiments, the invention provides a Class 3 glucagon related peptide modified to comprise an acyl group or alkyl group covalently linked to the amino acid at position 10 of the glucagon related peptide. The glucagon related peptide may further comprise a spacer between the amino acid at position 10 of the Class 3 glucagon related peptide and the acyl group or alkyl group. Any of the foregoing Class 3 glucagon related peptides may comprise two acyl groups or two alkyl groups, or a combination thereof. In a specific aspect of the invention, the acylated Class 3 glucagon related peptide comprises the amino acid sequence of any of SEQ ID NOs: 534-544 and 546-549.

C-terminal Truncation

In some embodiments, the Class 3 glucagon related peptides described herein are further modified by truncation or deletion of one or two amino acids of the C-terminus of the glucagon peptide (i.e., position 29 and/or 28) without affecting activity and/or potency at the glucagon and GLP-1 receptors. In this regard, the Class 3 glucagon related peptide can comprise amino acids 1-27 or 1-28 of the native glucagon peptide (SEQ ID NO: 1), optionally with one or more modifications described herein. In some embodiments, the truncated Class 3 glucagon related peptide comprises SEQ ID NO: 550 or SEQ ID NO: 551. In another embodiment, the truncated glucagon agonist peptide comprises SEQ ID NO: 552 or SEQ ID NO: 553.

C-terminal Extension

In accordance with some embodiments, the Class 3 glucagon related peptides disclosed herein are modified by the addition of a second peptide to the carboxy terminus of the glucagon related peptide, for example, SEQ ID NO: 78, SEQ ID NO: 117 or SEQ ID NO: 118. In some embodiments, a Class 3 glucagon related peptide having a sequence selected from the group consisting of SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 109, SEQ ID NO: 110, SEQ ID NO: 111, and SEQ ID NO: 69 is covalently bound through a peptide bond to a second peptide, wherein the second peptide comprises a sequence selected from the group consisting of SEQ ID NO: 78, SEQ ID NO: 117 and SEQ ID NO: 118. In a further embodiment, in Class 3 glucagon related peptides which comprise the C-terminal extension, the threonine at position 29 of the native glucagon related peptide is replaced with a glycine. A Class 3 glucagon related peptide having a glycine substitution for threonine at position 29 and comprising the carboxy terminal extension of SEQ ID NO: 78 is four times as potent at the GLP-1 receptor as native glucagon modified to comprise the carboxy terminal extension of SEQ ID NO: 78. Potency at the GLP-1 receptor can be further enhanced by an alanine substitution for the native arginine at position 18.

Accordingly, the Class 3 glucagon related peptide can have a carboxy terminal extension of SEQ ID NO: 117 (KRNRNNIA) or SEQ ID NO: 118. In accordance with some embodiments, Class 3 glucagon related peptide comprising SEQ ID NO: 81 or SEQ ID NO: 108, further comprises the amino acid sequence of SEQ ID NO: 117 (KRNRNNIA) or SEQ ID NO: 118 linked to amino acid 29 of the glucagon related peptide. More particularly, the Class 3 glucagon related peptide comprises a sequence selected from the group consisting of SEQ ID NO: 98, SEQ ID NO: 100, SEQ ID NO: 101, SEQ ID NO: 102 and SEQ ID NO: 103, further comprising the amino acid sequence of SEQ ID NO: 117 (KRNRNNIA) or SEQ ID NO: 118 linked to amino acid 29 of the glucagon related peptide. More particularly, the glucagon related peptide comprises a sequence selected from the group consisting of SEQ ID NO: 98, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 109, SEQ ID NO: 110, SEQ ID NO: 111, SEQ ID NO: 112, SEQ ID NO: 72 and SEQ ID NO: 120 further comprising the amino acid sequence of SEQ ID NO: 78 (GPSSGAPPPS) or SEQ ID NO: 79 linked to amino acid 29 of the Class 3 glucagon related peptide. In some embodiments, the Class 3 glucagon related peptide comprises the sequence of SEQ ID NO: 121.

Any of the modifications described above with regard to Class 3 glucagon related peptides which increase or decrease glucagon receptor activity and which increase GLP-1 receptor activity can be applied individually or in combination. Exemplary modifications include but are not limited to:

(A) Improving solubility, for example, by introducing one, two, three or more charged amino acid(s) to the C-terminal portion of native glucagon, preferably at a position C-terminal to position 27. Such a charged amino acid can be introduced by substituting a native amino acid with a charged amino acid, e.g. at positions 28 or 29, or alternatively by adding a charged amino acid, e.g. after position 27, 28 or 29. In exemplary embodiments, one, two, three or all of the charged amino acids are negatively charged. In other embodiments, one, two, three or all of the charged amino acids are positively charged. Such modifications increase solubility, e.g. provide at least 2-fold, 5-fold, 10-fold, 15-fold, 25-fold, 30-fold or greater solubility relative to native glucagon at a given pH between about 5.5 and 8, e.g., pH 7, when measured after 24 hours at 25° C.

(B) Increasing solubility and duration of action or half-life in circulation by addition of a hydrophilic moiety such as a polyethylene glycol chain, as described herein, e.g. at position 16, 17, 20, 21, 24 or 29, or at the C-terminal amino acid of the peptide.

(C) Increasing stability by modification of the aspartic acid at position 15, for example, by deletion or substitution with glutamic acid, homoglutamic acid, cysteic acid or homocysteic acid. Such modifications can reduce degradation or cleavage at a pH within the range of 5.5 to 8, especially in acidic or alkaline buffers, for example, retaining at least 75%, 80%, 90%, 95%, 96%, 97%, 98% or 99% of the original peptide after 24 hours at 25° C.

(D) Increasing stability by modification of the methionine at position 27, for example, by substitution with leucine or norleucine. Such modifications can reduce oxidative degradation. Stability can also be increased by modification of the Gln at position 20 or 24, e.g. by substitution with Ser, Thr, Ala or AIB. Such modifications can reduce degradation that occurs through deamidation of Gln. Stability can be increased by modification of Asp at position 21, e.g. by substitution with Glu. Such modifications can reduce degradation that occurs through dehydration of Asp to form a cyclic succinimide intermediate followed by isomerization to iso-aspartate.

(E) Increasing resistance to dipeptidyl peptidase IV (DPP IV) cleavage by modification of the amino acid at position 1 or 2 with the DPP-IV resistant amino acids described herein and including modification of the amino acid at position 2 with N-methyl-alanine.

(F) Conservative or non-conservative substitutions, additions or deletions that do not affect activity, for example, conservative substitutions at one or more of positions 2, 5, 7, 10, 11, 12, 13, 14, 16, 17, 18, 19, 20, 21, 24, 27, 28 or 29; deletions at one or more of positions 27, 28 or 29; or a deletion of amino acid 29 optionally combined with a C-terminal amide or ester in place of the C-terminal carboxylic acid group;

(G) Adding C-terminal extensions as described herein;

(H) Increasing half-life in circulation and/or extending the duration of action and/or delaying the onset of action, for example, through acylation or alkylation of the glucagon related peptide, as described herein;

(I) Homodimerization or heterodimerization as described herein.

Other modifications include substitution of His at position 1 with a large, aromatic amino acid (e.g., Tyr, Phe, Trp or amino-Phe); Ser at position 2 with Ala; substitution of Tyr at position 10 with Val or Phe; substitution of Lys at position 12 with Arg; substitution of Asp at position 15 with Glu; substitution of Ser at position 16 with Thr or AIB.

Class 3 glucagon related peptides with GLP-1 activity that contain a non-conservative substitution of His at position 1 with a large, aromatic amino acid (e.g., Tyr) can retain GLP-1 activity provided that the alpha-helix is stabilized via an intramolecular bridge, e.g., such as any of those described herein.

Conjugates and Fusions

The Class 3 glucagon related peptide can be linked, optionally via covalent bonding and optionally via a linker, to a conjugate moiety. The Class 3 glucagon related peptide also can be part of a fusion peptide or protein wherein a second peptide or polypeptide has been fused to a terminus, e.g., the carboxy terminus of the Class 3 glucagon related peptide. More particularly, the fusion Class 3 glucagon related peptide may comprise a glucagon agonist of SEQ ID NO: 72, SEQ ID NO: 97 or SEQ ID NO: 98 further comprising an amino acid sequence of SEQ ID NO: 78 (GPSSGAPPPS), SEQ ID NO: 117 (KRNRNNIA) or SEQ ID NO: 118 (KRNR) linked to amino acid 29 of the glucagon related peptide. In some embodiments, the amino acid sequence of SEQ ID NO: 78 (GPSSGAPPPS), SEQ ID NO: 117 (KRNRNNIA) or SEQ ID NO: 118 (KRNR) is bound to amino acid 29 of the Class 3 glucagon related peptide through a peptide bond. Applicants have discovered that in Class 3 glucagon related peptide fusion peptides comprising the C-terminal extension peptide of Exendin-4 (e.g., SEQ ID NO: 78 or SEQ ID NO: 79), substitution of the native threonine residue at position 29 with glycine dramatically increases GLP-1 receptor activity. This amino acid substitution can be used in conjunction with other modifications disclosed herein with regard to Class 3 glucagon related peptides to enhance the affinity of the glucagon analogs for the GLP-1 receptor. For example, the T29G substitution can be combined with the S16E and N20K amino acid substitutions, optionally with a lactam bridge between amino acids 16 and 20, and optionally with addition of a PEG chain as described herein.

In some embodiments, a Class 3 glucagon related peptide comprises the sequence of SEQ ID NO: 121. In some embodiments, the Class 3 glucagon related peptide portion of the glucagon fusion peptide is selected from the group consisting of SEQ ID NO: 72, SEQ ID NO: 90, SEQ ID NO: 91, SEQ ID NO: 92, and SEQ ID NO: 93 wherein a PEG chain, when present at positions 17, 21, 24, or the C-terminal amino acid, or at both 21 and 24, is selected from the range of 500 to 40,000 Daltons. More particularly, in some embodiments, the Class 3 glucagon related peptide segment is selected from the group consisting of SEQ ID NO: 95, SEQ ID NO: 96, and SEQ ID NO: 122, wherein the PEG chain is selected from the range of 500 to 5,000. In some embodiments, the Class 3 glucagon related peptide is a fusion peptide comprising the sequence of SEQ ID NO: 72 and SEQ ID NO: 80 wherein the peptide of SEQ ID NO: 80 is linked to the carboxy terminus of SEQ ID NO: 72.

In accordance with some embodiments, an additional chemical modification of the Class 3 glucagon related peptide of SEQ ID NO: 98 bestows increased GLP-1 receptor potency to a point where the relative activity at the glucagon and GLP-1 receptors is virtually equivalent. Accordingly, in some embodiments, a Class 3 glucagon related peptide comprises a terminal amino acid comprising an amide group in place of the carboxylic acid group that is present on the native amino acid. The relative activity of the Class 3 glucagon related peptide at the respective glucagon and GLP-1 receptors can be adjusted by further modifications to the Class 3 glucagon related peptide to produce analogs demonstrating about 40% to about 500% or more of the activity of native glucagon at the glucagon receptor and about 20% to about 200% or more of the activity of native GLP-1 at the GLP-1 receptor, e.g. 50-fold, 100-fold or more increase relative to the normal activity of glucagon at the GLP-1 receptor.

Exemplary Embodiments

In accordance with some embodiments, a glucagon analog is provided comprising the sequence of SEQ ID NO: 72, wherein said analog differs from SEQ ID NO: 72 by 1 to 3 amino acids, selected from positions 1, 2, 3, 5, 7, 10, 11, 13, 14, 17, 18, 19, 21, 24, 27, 28, and 29, wherein said glucagon related peptide exhibits at least 20% of the activity of native GLP-1 at the GLP-1 receptor.

In accordance with some embodiments a glucagon/GLP-1 receptor co-agonist is provided comprising the sequence: NH2-His-Ser-Gln-Gly-Thr-Phe-Thr-Ser-Asp-Tyr-Ser-Lys-Tyr-Leu-Xaa-Xaa-Arg-Arg-Ala-Xaa-Asp-Phe-Val-Xaa-Trp-Leu-Met-Xaa-Xaa-R (SEQ ID NO: 81) wherein the Xaa at position 15 is selected from the group of amino acids consisting of Asp, Glu, cysteic acid, homoglutamic acid and homocysteic acid, Xaa at position 16 is selected from the group of amino acids consisting of Ser, Glu, Gln, homoglutamic acid and homocysteic acid, the Xaa at position 20 is Gln or Lys, the Xaa at position 24 is Gln or Glu, the Xaa at position 28 is Asn, Lys or an acidic amino acid, the Xaa at position 29 is Thr, Gly or an acidic amino acid, and R is COOH or CONH2, with the proviso that when position 16 is serine, position 20 is Lys, or alternatively when position 16 is serine the position 24 is Glu and either position 20 or position 28 is Lys. In some embodiments the glucagon/GLP-1 receptor co-agonist comprises the sequence of SEQ ID NO: 81 wherein the amino acid at position 28 is aspartic acid and the amino acid at position 29 is glutamic acid. In another embodiment the amino acid at position 28 is the native asparagine, the amino acid at position 29 is glycine and the amino acid sequence of SEQ ID NO: 79 or SEQ ID NO: 80 is covalently linked to the carboxy terminus of SEQ ID NO: 81.

In some embodiments a co-agonist is provided comprising the sequence of SEQ ID NO: 81 wherein an additional acidic amino acid added to the carboxy terminus of the peptide. In a further embodiment the carboxy terminal amino acid of the glucagon analog has an amide in place of the carboxylic acid group of the natural amino acid. In some embodiments the glucagon analog comprises a sequence selected from the group consisting of SEQ ID NO: 85, SEQ ID NO: 86, SEQ ID NO: 87, and SEQ ID NO: 88.

In accordance with some embodiments a glucagon related peptide analog of SEQ ID NO: 81 is provided, wherein said analog differs from SEQ ID NO: 81 by 1 to 3 amino acids, selected from positions 1, 2, 3, 5, 7, 10, 11, 13, 14, 17, 18, 19, 21 and 27, with the proviso that when the amino acid at position 16 is serine, either position 20 is lysine, or a lactam bridge is formed between the amino acid at position 24 and either the amino acid at position 20 or position 28. In accordance with some embodiments the analog differs from SEQ ID NO: 81 by 1 to 3 amino acids selected from positions 1, 2, 3, 21 and 27. In some embodiments the glucagon peptide analog of SEQ ID NO: 81 differs from that sequence by 1 to 2 amino acids, or in some embodiments by a single amino acid, selected form positions 1, 2, 3, 5, 7, 10, 11, 13, 14, 17, 18, 19, 21 and 27, with the proviso that when the amino acid at position 16 is serine, either position 20 is lysine, or a lactam bridge is formed between the amino acid at position 24 and either the amino acid at position 20 or position 28.

In accordance with another embodiment a relatively selective GLP-1 receptor agonist is provided comprising the sequence NH2-His-Ser-Xaa-Gly-Thr-Phe-Thr-Ser-Asp-Tyr-Ser-Lys-Tyr-Leu-Xaa-Xaa-Arg-Arg-Ala-Xaa-Asp-Phe-Val-Xaa-Trp-Leu-Met-Xaa-Xaa-R (SEQ ID NO: 83) wherein the Xaa at position 3 is selected from the group of amino acids consisting of Glu, Orn or Nle, the Xaa at position 15 is selected from the group of amino acids consisting of Asp, Glu, cysteic acid, homoglutamic acid and homocysteic acid, Xaa at position 16 is selected from the group of amino acids consisting of Ser, Glu, Gln, homoglutamic acid and homocysteic acid, the Xaa at position 20 is Gln or Lys, the Xaa at position 24 is Gln or Glu, the Xaa at position 28 is Asn, Lys or an acidic amino acid, the Xaa at position 29 is Thr, Gly or an acidic amino acid, and R is COOH, CONH2, SEQ ID NO: 78 or SEQ ID NO: 79, with the proviso that when position 16 is serine, position 20 is Lys, or alternatively when position 16 is serine the position 24 is Glu and either position 20 or position 28 is Lys. In some embodiments the amino acid at position 3 is glutamic acid. In some embodiments the acidic amino acid substituted at position 28 and/or 29 is aspartic acid or glutamic acid.

In some embodiments the glucagon related peptide, including a co-agonist peptide, comprises the sequence of SEQ ID NO: 81 further comprising an additional acidic amino acid added to the carboxy terminus of the peptide. In a further embodiment the carboxy terminal amino acid of the glucagon analog has an amide in place of the carboxylic acid group of the natural amino acid.

In accordance with some embodiments a glucagon/GLP-1 receptor co-agonist is provided comprising a modified glucagon related peptide selected from the group consisting of: NH2-His-Ser-Gln-Gly-Thr-Phe-Thr-Ser-Asp-Tyr-Ser-Lys-Tyr-Leu-Xaa-Xaa-Arg-Arg-Ala-Xaa-Asp-Phe-Val-Xaa-Trp-Leu-Met-Xaa-Xaa-R (SEQ ID NO: 81), wherein the Xaa at position 15 is selected from the group of amino acids consisting of Asp, Glu, cysteic acid, homoglutamic acid and homocysteic acid, Xaa at position 16 is selected from the group of amino acids consisting of Ser, Glu, Gln, homoglutamic acid and homocysteic acid, the Xaa at position 20 is Gln or Lys, the Xaa at position 24 is Gln or Glu and the Xaa at position 28 is Asn, Asp or Lys, R is COOH or CONH2, the Xaa at position 29 is Thr or Gly, and R is COOH, CONH2, SEQ ID NO: 78 or SEQ ID NO: 79, with the proviso that when position 16 is serine, position 20 is Lys, or alternatively when position 16 is serine the position 24 is Glu and either position 20 or position 28 is Lys. In some embodiments R is CONH2, the Xaa at position 15 is Asp, the Xaa at position 16 is selected from the group of amino acids consisting of Glu, Gln, homoglutamic acid and homocysteic acid, the Xaas at positions 20 and 24 are each Gln the Xaa at position 28 is Asn or Asp and the Xaa at position 29 is Thr. In some embodiments the Xaas at positions 15 and 16 are each Glu, the Xaas at positions 20 and 24 are each Gln, the Xaa at position 28 is Asn or Asp, the Xaa at position 29 is Thr and R is CONH2.

It has been reported that certain positions of the native glucagon peptide can be modified while retaining at least some of the activity of the parent peptide. Accordingly, applicants anticipate that one or more of the amino acids located at positions at positions 2, 5, 7, 10, 11, 12, 13, 14, 17, 18, 19, 20, 21, 24, 27, 28 or 29 of the peptide of SEQ ID NO: 99 can be substituted with an amino acid different from that present in the native glucagon peptide, and still retain activity at the glucagon receptor. In some embodiments the methionine residue present at position 27 of the native peptide is changed to leucine or norleucine to prevent oxidative degradation of the peptide. In another embodiment the amino acid at position 20 is substituted with Lys, Arg, Ornm or Citrullene and/or position 21 is substituted with Glu, homoglutamic acid or homocysteic acid.

In some embodiments a glucagon analog of SEQ ID NO: 108 is provided wherein 1 to 6 amino acids, selected from positions 1, 2, 5, 7, 10, 11, 13, 14, 17, 18, 19, 21, 27, 28 or 29 of the analog differ from the corresponding amino acid of SEQ ID NO: 701, with the proviso that when the amino acid at position 16 is serine, position 20 is Lys, or alternatively when position 16 is serine the position 24 is Glu and either position 20 or position 28 is Lys. In accordance with another embodiment a glucagon analog of SEQ ID NO: 108 is provided wherein 1 to 3 amino acids selected from positions 1, 2, 5, 7, 10, 11, 13, 14, 17, 18, 19, 20, 21, 27, 28 or 29 of the analog differ from the corresponding amino acid of SEQ ID NO: 701. In another embodiment, a glucagon analog of SEQ ID NO: 96, SEQ ID NO: 97 or SEQ ID NO: 99 is provided wherein 1 to 2 amino acids selected from positions 1, 2, 5, 7, 10, 11, 13, 14, 17, 18, 19, 20 or 21 of the analog differ from the corresponding amino acid of SEQ ID NO: 701, and in a further embodiment the one to two differing amino acids represent conservative amino acid substitutions relative to the amino acid present in the native glucagon sequence (SEQ ID NO: 701). In some embodiments a glucagon peptide of SEQ ID NO: 100, SEQ ID NO: 101, SEQ ID NO: 102 or SEQ ID NO: 103 is provided wherein the glucagon peptide further comprises one, two or three amino acid substitutions at positions selected from positions 2, 5, 7, 10, 11, 13, 14, 17, 18, 19, 20, 21, 27 or 29. In some embodiments the substitutions at positions 2, 5, 7, 10, 11, 13, 14, 16, 17, 18, 19, 20, 21, 27 or 29 are conservative amino acid substitutions.

In accordance with some embodiments a glucagon/GLP-1 receptor co-agonist is provided comprising a variant of the sequence of SEQ ID NO 81, wherein 1 to 10 amino acids selected from positions 16, 17, 18, 20, 21, 23, 24, 27, 28 and 29, respectively, of the variant differ from the corresponding amino acid of SEQ ID NO: 701. In accordance with some embodiments a variant of the sequence of SEQ ID NO 81 is provided wherein the variant differs from SEQ ID NO: 81 by one or more amino acid substitutions selected from the group consisting of Gln17, Ala18, Glu21, Ile23, Ala24, Val27 and Gly29. In accordance with some embodiments a glucagon/GLP-1 receptor co-agonist is provided comprising variants of the sequence of SEQ ID NO 81, wherein 1 to 2 amino acids selected from positions 17-26 of the variant differ from the corresponding amino acid of SEQ ID NO: 701. In accordance with some embodiments a variant of the sequence of SEQ ID NO 81 is provided wherein the variant differs from SEQ ID NO: 81 by an amino acid substitution selected from the group consisting of Gln17, Ala18, Glu21, Ile23 and Ala24. In accordance with some embodiments a variant of the sequence of SEQ ID NO 81 is provided wherein the variant differs from SEQ ID NO: 81 by an amino acid substitution at position 18 wherein the substituted amino acid is selected from the group consisting of Ala, Ser, Thr, and Gly. In accordance with some embodiments a variant of the sequence of SEQ ID NO 81 is provided wherein the variant differs from SEQ ID NO: 81 by an amino acid substitution of Ala at position 18. Such variations are encompassed by SEQ ID NO: 72. In another embodiment a glucagon/GLP-1 receptor co-agonist is provided comprising variants of the sequence of SEQ ID NO 81, wherein 1 to 2 amino acids selected from positions 17-22 of the variant differ from the corresponding amino acid of SEQ ID NO: 701, and in a further embodiment a variant of SEQ ID NO 81 is provided wherein the variant differs from SEQ ID NO: 81 by 1 or 2 amino acid substitutions at positions 20 and 21.

In accordance with some embodiments a glucagon/GLP-1 receptor co-agonist is provided comprising the sequence: NH2-His-Ser-Gln-Gly-Thr-Phe-Thr-Ser-Asp-Tyr-Ser-Lys-Tyr-Leu-Xaa-Xaa-Arg-Arg-Ala-Xaa-Xaa-Phe-Val-Xaa-Trp-Leu-Met-Xaa-Xaa-R (SEQ ID NO: 123), wherein the Xaa at position 15 is Asp, Glu, cysteic acid, homoglutamic acid or homocysteic acid, the Xaa at position 16 is Ser, Glu, Gln, homoglutamic acid or homocysteic acid, the Xaa at position 20 is Gln, Lys, Arg, Orn or citrulline, the Xaa at position 21 is Asp, Glu, homoglutamic acid or homocysteic acid, the Xaa at position 24 is Gln or Glu, the Xaa at position 28 is Asn, Lys or an acidic amino acid, the Xaa at position 29 is Thr or an acid amino acid and R is COOH or CONH$_2$. In some embodiments R is CONH$_2$. In accordance with some embodiments a glucagon/GLP-1 receptor co-agonist is provided comprising a variant of SEQ ID NO: 99, SEQ ID NO: 100, SEQ ID NO: 101, SEQ ID NO: 102, SEQ ID NO: 103, SEQ ID NO: 114, SEQ ID NO: 115 or SEQ ID NO: 116, wherein the variant differs from said sequence by an amino acid substitution at position 20. In some embodiments the amino acid substitution is selected form the group consisting of Lys, Arg, Orn or citrulline for position 20.

In some embodiments a glucagon agonist is provided comprising an analog peptide of SEQ ID NO: 82 wherein the analog differs from SEQ ID NO: 82 by having an amino acid other than serine at position 2. In some embodiments the serine residue is substituted with aminoisobutyric acid, D-alanine, and in some embodiments the serine residue is substituted with aminoisobutyric acid. Such modifications suppresses cleavage by dipeptidyl peptidase IV while retaining the inherent potency of the parent compound (e.g. at least 75, 80, 85, 90, 95% or more of the potency of the parent compound). In some embodiments the solubility of the analog is increased, for example, by introducing one, two, three or more charged amino acid(s) to the C-terminal portion of native glucagon, preferably at a position C-terminal to position 27. In exemplary embodiments, one, two, three or all of the charged amino acids are negatively charged. In another embodiment the analog further comprises an acidic amino acid substituted for the native amino acid at position 28 or 29 or an acidic amino acid added to the carboxy terminus of the peptide of SEQ ID NO: 82.

In some embodiments the glucagon analogs disclosed herein are further modified at position 1 or 2 to reduce susceptibility to cleavage by dipeptidyl peptidase IV. In some embodiments a glucagon analog of SEQ ID NO: 97, SEQ ID NO: 99, SEQ ID NO: 100, SEQ ID NO: 101, SEQ ID NO: 102 or SEQ ID NO: 103 is provided wherein the analog differs from the parent molecule by a substitution at position 2 and exhibits reduced susceptibility (i.e., resistance) to cleavage by dipeptidyl peptidase IV. More particularly, in some embodiments position 2 of the analog peptide is substituted with an amino acid selected from the group consisting of D-serine, D-alanine, valine, amino n-butyric acid, glycine, N-methyl serine and aminoisobutyric acid. In some embodiments position 2 of the analog peptide is substituted with an amino acid selected from the group consisting of D-serine, D-alanine, glycine, N-methyl serine and aminoisobutyric acid. In another embodiment position 2 of the analog peptide is substituted with an amino acid selected from the group consisting of D-serine, glycine, N-methyl serine and aminoisobutyric acid. In some embodiments the amino acid at position 2 is not D-serine. In some embodiments the glucagon related peptide comprises the sequence of SEQ ID NO: 127 or SEQ ID NO: 128.

In some embodiments a glucagon analog of SEQ ID NO: 97, SEQ ID NO: 99, SEQ ID NO: 100, SEQ ID NO: 101, SEQ ID NO: 102 or SEQ ID NO: 103 is provided wherein the analog differs from the parent molecule by a substitution at position 1 and exhibits reduced susceptibility (i.e., resistance) to cleavage by dipeptidyl peptidase IV. More particularly, position 1 of the analog peptide is substituted with an amino acid selected from the group consisting of D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and homo-histidine. In another embodiment a glucagon agonist is provided comprising an analog peptide of SEQ ID NO: 82 wherein the analog differs from SEQ ID NO: 82 by having an amino acid other than histidine at position 1. In some embodiments the solubility of the analog is increased, for example, by introducing one, two, three or more charged amino acid(s) to the C-terminal portion of native glucagon, preferably at a position C-terminal to position 27. In exemplary embodiments, one, two, three or all of the charged amino acids are negatively charged. In another embodiment the analog further comprises an acidic amino acid substituted for the native amino acid at position 28 or 29 or an acidic amino acid added to the carboxy terminus of the peptide of SEQ ID NO: 82. In some embodiments the acidic amino acid is aspartic acid or glutamic acid.

In some embodiments the glucagon/GLP-1 receptor co-agonist comprises a sequence of SEQ ID NO: 108 further comprising an additional carboxy terminal extension of one amino acid or a peptide selected from the group consisting of SEQ ID NO: 78, SEQ ID NO: 117 and SEQ ID NO: 118. In the embodiment wherein a single amino acid is added to the carboxy terminus of SEQ ID NO: 108, the amino acid is typically selected from one of the 20 common amino acids, and in some embodiments the additional carboxy terminus amino acid has an amide group in place of the carboxylic acid of the native amino acid. In some embodiments the additional amino acid is selected from the group consisting of glutamic acid, aspartic acid and glycine.

In an alternative embodiment a glucagon/GLP-1 receptor co-agonist is provided wherein the peptide comprises at least one lactam ring formed between the side chain of a glutamic acid residue and a lysine residue, wherein the glutamic acid residue and a lysine residue are separated by three amino acids. In some embodiments the carboxy terminal amino acid of the lactam bearing glucagon peptide has an amide group in place of the carboxylic acid of the native amino acid. More particularly, in some embodiments a glucagon and GLP-1 co-agonist is provided comprising a modified glucagon peptide selected from the group consisting of:

NH$_2$-His-Ser-Gln-Gly-Thr-Phe-Thr-Ser-Asp-Tyr-Ser-Lys-Tyr-Leu-Asp-Glu-Arg-Arg-Ala-Gln-Asp-Phe-Val-Gln-Trp-Leu-Met-Xaa-Xaa-R (SEQ ID NO: 109)

NH$_2$-His-Ser-Gln-Gly-Thr-Phe-Thr-Ser-Asp-Tyr-Ser-Lys-Tyr-Leu-Asp-Glu-Arg-Arg-Ala-Lys-Asp-Phe-Val-Gln-Trp-Leu-Met-Xaa-Xaa-R (SEQ ID NO: 110)

NH$_2$-His-Ser-Gln-Gly-Thr-Phe-Thr-Ser-Asp-Tyr-Ser-Lys-Tyr-Leu-Asp-Ser-Arg-Arg-Ala-Lys-Asp-Phe-Val-Glu-Trp-Leu-Met-Xaa-Xaa-R (SEQ ID NO: 111)

NH$_2$-His-Ser-Gln-Gly-Thr-Phe-Thr-Ser-Asp-Tyr-Ser-Lys-Tyr-Leu-Asp-Ser-Arg-Arg-Ala-Gln-Asp-Phe-Val-Glu-Trp-Leu-Met-Lys-Xaa-R (SEQ ID NO: 112)

NH$_2$-His-Ser-Gln-Gly-Thr-Phe-Thr-Ser-Asp-Tyr-Ser-Lys-Tyr-Leu-Asp-Glu-Arg-Arg-Ala-Lys-Asp-Phe-Val-Glu-Trp-Leu-Met-Asn-Thr-R (SEQ ID NO: 104)

NH$_2$-His-Ser-Gln-Gly-Thr-Phe-Thr-Ser-Asp-Tyr-Ser-Lys-Tyr-Leu-Asp-Glu-Arg-Arg-Ala-Gln-Asp-Phe-Val-Glu-Trp-Leu-Met-Lys-Thr-R (SEQ ID NO: 105)

NH$_2$-His-Ser-Gln-Gly-Thr-Phe-Thr-Ser-Asp-Tyr-Ser-Lys-Tyr-Leu-Asp-Glu-Arg-Arg-Ala-Lys-Asp-Phe-Val-Glu-Trp-Leu-Met-Lys-Thr-R (SEQ ID NO: 106)

wherein Xaa at position 28=Asp, or Asn, the Xaa at position 29 is Thr or Gly, R is selected from the group consisting of COOH, CONH$_2$, glutamic acid, aspartic acid, glycine, SEQ ID NO: 78, SEQ ID NO: 117 and SEQ ID NO: 118, and a lactam bridge is formed between Lys at position 12 and Glu at position 16 for SEQ ID NO: 109, between Glu at position 16 and Lys at position 20 for SEQ ID NO: 110, between Lys at position 20 and Glu at position 24 for SEQ ID NO: 111, between Glu at position 24 and Lys at position 28 for SEQ ID NO: 112, between Lys at position 12 and Glu at position 16 and between Lys at position 20 and Glu at position 24 for SEQ ID NO: 104, between Lys at position 12 and Glu at position 16 and between Glu at position 24 and Lys at position 28 for SEQ ID NO: 105 and between Glu at position 16 and Lys at position 20 and between Glu at position 24 and Lys at position 28 for SEQ ID NO: 106. In some embodiments R is selected from the group consisting of COOH, CONH$_2$, glutamic acid, aspartic acid, glycine, the amino acid at position 28 is Asn, and the amino acid at position 29 is threonine. In some embodiments R is CONH$_2$, the amino acid at position 28 is Asn and the amino acid at position 29 is threonine. In another embodiment R is selected from the group consisting of SEQ ID NO: 78, SEQ ID NO: 79 and SEQ ID NO: 80 and the amino acid at position 29 is glycine.

In a further embodiment the glucagon/GLP-1 receptor co-agonist is selected from the group consisting of SEQ ID NO: 99, SEQ ID NO: 100, SEQ ID NO: 101, SEQ ID NO: 102, SEQ ID NO: 103, SEQ ID NO: 104, SEQ ID NO: 105 and SEQ ID NO: 106, wherein the peptide further comprises an additional carboxy terminal extension of one amino acid or a peptide selected from the group consisting of SEQ ID NO: 78, SEQ ID NO: 117 and SEQ ID NO: 118. In some embodiments the terminal extension comprises the sequence of SEQ ID NO: 78, SEQ ID NO: 79 or SEQ ID NO: 80 and the glucagon related peptide comprises the sequence of SEQ ID NO: 72. In some embodiments the glucagon/GLP-1 receptor co-agonist comprises the sequence of SEQ ID NO: 81 wherein the amino acid at position 16 is glutamic acid, the amino acid at position 20 is lysine, the amino acid at position 28 is asparagine and the amino acid sequence of SEQ ID No: 78 or SEQ ID NO: 79 is linked to the carboxy terminus of SEQ ID NO: 81.

In the embodiment wherein a single amino acid is added to the carboxy terminus of SEQ ID NO: 108, the amino acid is typically selected from one of the 20 common amino acids, and in some embodiments the amino acid has an amide group in place of the carboxylic acid of the native amino acid. In some embodiments the additional amino acid is selected from the group consisting of glutamic acid and aspartic acid and glycine. In the embodiments wherein the glucagon agonist analog further comprises a carboxy terminal extension, the carboxy terminal amino acid of the extension, in some embodiments, ends in an amide group or an ester group rather than a carboxylic acid.

In another embodiment the glucagon/GLP-1 receptor co-agonist comprises the sequence: NH$_2$-His-Ser-Gln-Gly-Thr-Phe-Thr-Ser-Asp-Tyr-Ser-Lys-Tyr-Leu-Asp-Glu-Arg-Arg-Ala-Gln-Asp-Phe-Val-Gln-Trp-Leu-Met-Asn-Thr-Xaa-CONH$_2$ (SEQ ID NO: 107), wherein the Xaa at position 30 represents any amino acid. In some embodiments Xaa is selected from one of the 20 common amino acids, and in some embodiments the amino acid is glutamic acid, aspartic acid or glycine. The solubility of this peptide can be further improved by covalently linking a PEG chain to the side chain of amino acid at position 17, 21, 24 or 30 of SEQ ID NO: 107. In a further embodiment the peptide comprises an additional carboxy terminal extension of a peptide selected from the group consisting of SEQ ID NO: 78, SEQ ID NO: 117 and SEQ ID NO: 118. In accordance with some embodiments the glucagon/GLP-1 receptor co-agonist comprises the sequence of SEQ ID NO: 129, SEQ ID NO: 130 and SEQ ID NO: 131.

Additional site specific modifications internal to the glucagon sequence of SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107 and SEQ ID NO: 121 can be made to yield a set of glucagon agonists that possess variable degrees of GLP-1 agonism. Accordingly, peptides that possess virtually identical in vitro potency at each receptor have been prepared and characterized. Similarly, peptides with tenfold selectively enhanced potency at each of the two receptors have been identified and characterized. As noted above substitution of the serine residue at position 16 with glutamic acid enhances the potency of native glucagon at both the Glucagon and GLP-1 receptors, but maintains approximately a tenfold selectivity for the glucagon receptor. In addition by substituting the native glutamine at position 3 with glutamic acid (SEQ ID NO: 128) generates a glucagon analog that exhibits approximately a tenfold selectivity for the GLP-1 receptor.

The solubility of the glucagon/GLP-1 co-agonist peptides can be further enhanced in aqueous solutions at physiological pH, while retaining the high biological activity relative to native glucagon by the introduction of hydrophilic groups at positions 16, 17, 21, and 24 of the peptide, or by the addition of a single modified amino acid (i.e., an amino acid modified to comprise a hydrophilic group) at the carboxy terminus of the glucagon/GLP-1 co-agonist peptide. In accordance with some embodiments the hydrophilic group comprises a polyethylene (PEG) chain. More particularly, in some embodiments the glucagon peptide comprises the sequence of SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105 or SEQ ID NO: 106 wherein a PEG chain is covalently linked to the side chain of an amino acids at position 16, 17, 21, 24, 29 or the C-terminal amino acid of the glucagon peptide, with the proviso that when the peptide comprises SEQ ID NO: 98, SEQ ID NO: 99, SEQ ID NO: 100 or SEQ ID NO: 101 the polyethylene glycol chain is covalently bound to an amino acid residue at position 17, 21 or 24, when the peptide comprises SEQ ID NO: 102 or SEQ ID NO: 103 the polyethylene glycol chain is covalently bound to an amino acid residue at position 16, 17 or 21, and when the peptide comprises SEQ ID NO: 104, SEQ ID NO: 105 or SEQ ID NO: 106 the polyethylene glycol chain is covalently bound to an amino acid residue at position 17 or 21.

In some embodiments the glucagon peptide comprises the sequence of SEQ ID NO: 99, SEQ ID NO: 100 or SEQ ID NO: 101, wherein a PEG chain is covalently linked to the side chain of an amino acids at position 17, 21, 24, or the C-terminal amino acid of the glucagon peptide, and the carboxy terminal amino acid of the peptide has an amide group in place of the carboxylic acid group of the native amino acid. In some embodiments the glucagon/GLP-1 receptor co-agonist peptide comprises a sequence selected from the group consisting of SEQ ID NO: 100, SEQ ID NO: 101, SEQ ID NO: 102, SEQ ID NO: 103, SEQ ID NO: 104, SEQ ID NO: 105, SEQ ID NO: 106 and SEQ ID NO: 107, wherein a PEG chain is covalently linked to the side chain of an amino acid at position 17, 21 or 24 of SEQ ID NO: 100, SEQ ID NO: 101 and SEQ ID NO: 107, or at position 16, 17 or 21 of SEQ ID NO: 102 and SEQ ID NO: 103 or at position 17 or 21 of SEQ ID NO: 104, SEQ ID NO: 105 and SEQ ID NO: 106 of the glucagon peptide. In another embodiment the glucagon/GLP-1 receptor co-agonist peptide comprises the sequence of SEQ ID NO: 99 or SEQ ID NO: 107, wherein a PEG chain is covalently linked to the side chain of an amino acids at position 17, 21 or 24 or the C-terminal amino acid of the glucagon peptide.

In some embodiments a glucagon peptide selected from the group consisting of SEQ ID NO: 100, SEQ ID NO: 101, SEQ ID NO: 102, SEQ ID NO: 103, SEQ ID NO: 104, SEQ ID NO: 105, SEQ ID NO: 106, and SEQ ID NO: 107 is further modified to comprise a PEG chain covalently linked to the side chain of an amino acid at position 17 or 21 of the glucagon peptide. In some embodiments the pegylated glucagon/GLP-1 receptor co-agonist further comprises the sequence of SEQ ID NO: 78, SEQ ID NO: 117 or SEQ ID NO: 79.

In another embodiment the glucagon related peptide comprises the sequence of SEQ ID NO: 72 or SEQ ID NO: 120, further comprising a C-terminal extension of SEQ ID NO: 78, SEQ ID NO: 79 or SEQ ID NO: 80 linked to the C-terminal amino acid of SEQ ID NO: 72 or SEQ ID NO: 120, and optionally further comprising a PEG chain covalently linked to the side chain of an amino acids at position 17, 18, 21, 24 or 29 or the C-terminal amino acid of the peptide. In another embodiment the glucagon related peptide comprises the sequence of SEQ ID NO: 72 or SEQ ID NO: 120, wherein a PEG chain is covalently linked to the side chain of an amino acids at position 21 or 24 of the glucagon related peptide and the peptide further comprises a C-terminal extension of SEQ ID NO: 78, or SEQ ID NO: 79.

In another embodiment the glucagon related peptide comprises the sequence of SEQ ID NO: 72, or SEQ ID NO: 81 or SEQ ID NO: 82, wherein an additional amino acid is added to the carboxy terminus of SEQ ID NO: 81 or SEQ ID NO: 82, and a PEG chain is covalently linked to the side chain of the added amino acid. In a further embodiment, the pegylated glucagon analog further comprises a C-terminal extension of SEQ ID NO: 78 or SEQ ID NO: 79 linked to the C-terminal amino acid of SEQ ID NO: 81 or SEQ ID NO: 82. In another embodiment the glucagon related peptide comprises the sequence of SEQ ID NO: 107, wherein a PEG chain is covalently linked to the side chain of the amino acid at position 30 of the glucagon related peptide and the peptide further comprises a C-terminal extension of SEQ ID NO: 78 or SEQ ID NO: 79 linked to the C-terminal amino acid of SEQ ID NO: 107.

The polyethylene glycol chain may be in the form of a straight chain or it may be branched. In accordance with some embodiments the polyethylene glycol chain has an average molecular weight selected from the range of about 500 to about 10,000 Daltons. In some embodiments the polyethylene glycol chain has an average molecular weight selected from the range of about 1,000 to about 5,000 Daltons. In an alternative embodiment the polyethylene glycol chain has an average molecular weight selected from the range of about 10,000 to about 20,000 Daltons. In accordance with some embodiments the pegylated glucagon related peptide comprises two or more polyethylene glycol chains covalently bound to the glucagon related peptide wherein the total molecular weight of the glucagon chains is about 1,000 to about 5,000 Daltons. In some embodiments the pegylated glucagon agonist comprises a peptide consisting of SEQ ID NO: 93 or a glucagon agonist analog of SEQ ID NO: 93, wherein a PEG chain is covalently linked to the amino acid residue at position 21 and at position 24, and wherein the combined molecular weight of the two PEG chains is about 1,000 to about 5,000 Daltons.

In certain exemplary embodiments, the glucagon peptide comprises the amino acid sequence of SEQ ID NO: 701 with up to ten amino acid modifications and comprises an amino acid at position 10 which is acylated or alkylated. In some embodiments, the amino acid at position 10 is acylated or alkylated with a C4 to C30 fatty acid. In certain aspects, the amino acid at position 10 comprises an acyl group or an alkyl group which is non-native to a naturally-occurring amino acid.

In certain embodiments, the glucagon peptide comprising an amino acid at position 10 which is acylated or alkylated comprises a stabilized alpha helix. Accordingly, in certain aspects, the glucagon peptide comprises an acyl or alkyl group as described herein and an intramolecular bridge, e.g., a covalent intramolecular bridge (e.g., a lactam bridge) between the side chains of an amino acid at position i and an amino acid at position i+4, wherein i is 12, 16, 20, or 24. Alternatively or additionally, the glucagon peptide comprises an acyl or alkyl group as described herein and one, two, three or more of positions 16, 20, 21 and/or 24 of the glucagon peptide are substituted with an α,α-disubstituted amino acid, e.g., AIB. In some instances, the non-native glucagon peptide comprises Glu at position 16 and Lys at position 20, wherein optionally a lactam bridge links the Glu and the Lys, and, optionally, the glucagon peptide further comprises one or more modifications selected from the group consisting of: Gln at position 17, Ala at position 18, Glu at position 21, Ile at position 23, and Ala at position 24.

Also, in any of the embodiments, wherein the glucagon related peptide comprises an amino acid at position 10 which is acylated or alkylated, the glucagon related peptide can further comprise a C-terminal amide in lieu of the C-terminal alpha carboxylate.

In some embodiments, the glucagon related peptide comprising an acyl or alkyl group as described herein further comprises an amino acid substitution at position 1, at position 2, or at positions 1 and 2, wherein the amino acid substitution(s) achieve DPP-IV protease resistance. In certain specific embodiments, the glucagon related peptide is one which comprises SEQ ID NOs: 72 with an amino acid at position 10 acylated or alkylated as described herein. The acyl or alkyl group of these embodiments may be any acyl or alkyl group described herein. For example, the acyl group may be a C4 to C30 (e.g., C8 to C24) fatty acyl group and the alkyl group may be a C4 to C30 (e.g., C8 to C24) alkyl group.

The amino acid to which the acyl or alkyl group is attached may be any of the amino acids described herein, e.g., an amino acid of any of Formula I (e.g., Lys), Formula II, and Formula III.

In some embodiments, the acyl group or alkyl group is directly attached to the amino acid at position 10. In some embodiments, the acyl or alkyl group is attached to the amino acid at position 10 via a spacer, such as, for example, a spacer which is 3 to 10 atoms in length, e.g., an amino acid or dipeptide. Suitable spacers for purposes of attaching an acyl or alkyl group are described herein.

In certain aspects, the glucagon analogs comprise at least one amino acid modification and up to 15 amino acid modifications (e.g., 1, 2, 3, 4, 5, 6, 7, 8, 9, 10, 11, 12, 13, 14, 15 amino acid modifications), or up to 10 amino acid modifications. In certain embodiments, the analogs comprising at least one amino acid modification and up to 10 amino acid modifications represent conservative amino acid modifications. Conservative amino acid modifications are described herein.

Accordingly, in some aspects, the glucagon analog comprises the amino acid sequence of SEQ ID NO: 701 with one or more of: Gln at position 17, Ala at position 18, Glu at position 21, Ile at position 23, and Ala or Cys at position 24, or conservative amino acid substitutions thereof. In some aspects, the analog comprises a C-terminal amide in place of the C-terminal alpha carboxylate. In certain embodiments, the analog comprises an amino acid substitution at position 1, position 2, or positions 1 and 2, which substitution(s) achieve DPP-IV protease resistance. Suitable amino acid substitutions are described herein. For example, DMIA at position 1 and/or d-Ser or AIB at position 2. In some embodiments, the amino acid at position 2 is not D-serine.

Additionally or alternatively, the analog may comprise one or a combination of: (a) Ser at position 2 substituted with Ala; (b) Gln at position 3 substituted with Glu or a glutamine analog; (c) Thr at position 7 substituted with a Ile; (d) Tyr at position 10 substituted with Trp or an amino acid comprising an acyl or alkyl group which is non-native to a naturally-occurring amino acid; (e) Lys at position 12 substituted with Ile; (f) Asp at position 15 substituted with Glu; (g) Ser at position 16 substituted with Glu; (h) Gln at position 20 substituted with Ser, Thr, Ala, AIB; (i) Gln at position 24 substituted with Ser, Thr, Ala, AIB; (j) Met at position 27 substituted with Leu or Nle; (k) Asn at position 29 substituted with a charged amino acid, optionally, Asp or Glu; and (l) Thr at position 29 substituted with Gly or a charged amino acid, optionally, Asp or Glu. In certain aspects, the analog comprises the amino acid sequence of any of SEQ ID NOs: 657-669.

With regard to the analogs which exhibit agonist activity at the GIP receptor, the analog comprises an extension of 1-21 amino acids (e.g., 5-19, 7-15, 9-12 amino acids). The extension of the analog may comprise any amino acid sequence, provided that the extension is 1 to 21 amino acids. In some aspects, the extension is 7 to 15 amino acids and in other aspects, the extension is 9 to 12 amino acids. In some embodiments, the extension comprises (i) the amino acid sequence of SEQ ID NO: 78 or 674, (ii) an amino acid sequence which has high sequence identity (e.g., at least 80%, 85%, 90%, 95%, 98%, 99%) with the amino acid sequence of SEQ ID NO: 78 or 674, or (iii) the amino acid sequence of (i) or (ii) with one or more conservative amino acid modifications.

In some embodiments, at least one of the amino acids of the extension is acylated or alkylated. The amino acid comprising the acyl or alkyl group may be located at any position of extension of the analog. In certain embodiments, the acylated or alkylated amino acid of the extension is located at one of positions 37, 38, 39, 40, 41, or 42 (according to the numbering of SEQ ID NO: 701) of the analog. In certain embodiments, the acylated or alkylated amino acid is located at position 40 of the analog.

In exemplary embodiments, the acyl or alkyl group is an acyl or alkyl group which is non-native to a naturally-occurring amino acid. For example, the acyl or alkyl group may be a C4 to C30 (e.g., C12 to C18) fatty acyl group or C4 to C30 (e.g., C12 to C18) alkyl. The acyl or alkyl group may be any of those discussed herein.

In some embodiments, the acyl or alkyl group is attached directly to the amino acid, e.g., via the side chain of the amino acid. In other embodiments, the acyl or alkyl group is attached to the amino acid via a spacer (e.g., an amino acid, a dipeptide, a tripeptide, a hydrophilic bifunctional spacer, a hydrophobic bifunctional spacer). In certain aspects, the spacer is 3 to 10 atoms in length. In some embodiments, the amino acid spacer is not γ-Glu. In some embodiments, the dipeptide spacer is not γ-Glu-γ-Glu.

Also, in exemplary embodiments, the amino acid to which the acyl or alkyl group is attached may be any of those described herein, including, for example, an amino acid of Formula I, II, or III. The amino acid which is acylated or alkylated may be a Lys, for example. Suitable amino acids comprising an acyl or alkyl group, as well as suitable acyl groups and alkyl groups, are described herein. See, for example, the teachings under the sections entitled *Acylation* and *Alkylation*.

In other embodiments, 1-6 amino acids (e.g., 1-2, 1-3, 1-4, 1-5 amino acids) of the extension are positive-charged amino acids, e.g., amino acids of Formula IV, such as, for example, Lys. As used herein, the term "positive-charged amino acid" refers to any amino acid, naturally-occurring or non-naturally occurring, comprising a positive charge on an atom of its side chain at a physiological pH. In certain aspects, the positive-charged amino acids are located at any of positions 37, 38, 39, 40, 41, 42, and 43. In specific embodiments, a positive-charged amino acid is located at position 40. In other instances, the extension is acylated or alkylated as described herein and comprises 1-6 positive charged amino acids as described herein.

In yet other embodiments, the analogs which exhibit agonist activity at the GIP receptor comprises (i) SEQ ID NO: 701 with at least one amino acid modification, (ii) an extension of 1 to 21 amino acids (e.g., 5 to 18, 7 to 15, 9 to 12 amino acids) C-terminal to the amino acid at position 29 of the analog, and (iii) an amino acid comprising an acyl or alkyl group which is non-native to a naturally-occurring amino acid which is located outside of the C-terminal extension (e.g., at any of positions 1-29). In some embodiments, the analog comprises an acylated or alkylated amino acid at position 10. In particular aspects, the acyl or alkyl group is a C4 to C30 fatty acyl or C4 to C30 alkyl group. In some embodiments, the acyl or alkyl group is attached via a spacer, e.g., an amino acid, dipeptide, tripeptide, hydrophilic bifunctional spacer, hydrophobic bifunctional spacer). In certain aspects, the analog comprises an amino acid modification which stabilizes the alpha helix, such as a salt bridge between a Glu at position 16 and a Lys at position 20, or an alpha, alpha-disubstituted amino acid at any one, two, three, or more of positions 16, 20, 21, and 24. In specific aspects, the analog additionally comprises amino acid modifications which confer DPP-IV protease resistance, e.g., DMIA at position 1, AIB at position 2. Analogs comprising further amino acid modifications are contemplated herein. In one embodiment the Class 3 glucagon related peptide comprises the structures of any of SEQ ID NOs: 657-669.

In accordance with some embodiments, the Class 3 glucagon related peptide comprises the amino acid sequence of native glucagon (SEQ ID NO: 701) comprising the following modifications: AIB at position 2, Glu at position 3, Lys at position 10, Glu at position 16, Gln at position 17, Ala at position 18, Lys at position 20, Glu at position 21, Ile at position 23, Ala at position 24; wherein Lys at position 10 is acylated with a C14 or C16 fatty acid, and wherein the C-terminal carboxylate is replaced with an amide. In a specific embodiment, this Class 3 glucagon related peptide is attached via its N-terminal amino acid to the dipeptide D-Lys-Sarcosine.

In accordance with some embodiments, the Class 3 glucagon related peptide comprises, consists essentially of, or consists of an amino acid sequence of any of SEQ ID NOs: 514, 517-534, or 554, optionally with up to 1, 2, 3, 4, or 5 further modifications that retain GLP-1 agonist and/or glucagon agonist activity. In certain embodiments, the Class 3 glucagon related peptide comprises the amino acids of any of SEQ ID NOs: 562-684, and 1701-1776. In some embodiments, the Class 3 glucagon related peptide comprises the amino acid sequences of any of SEQ ID NOs: 1801-1908.

The disclosed incretin-insulin peptide conjugates are believed to be suitable for any use that has previously been described for insulin peptides or for glucagon related peptides, including the use to reduce weight or prevent weight gain. Accordingly, the incretin-insulin conjugates described herein can be used to treat hyperglycemia, or treat other metabolic diseases that result from high blood glucose levels. Accordingly, the present invention encompasses pharmaceutical compositions comprising a incretin-insulin conjugate as disclosed herein and a pharmaceutically acceptable carrier for use in treating a patient suffering from high blood glucose levels. In accordance with one embodiment the patient to be treated using an incretin-insulin conjugate disclosed herein is a domesticated animal, and in another embodiment the patient to be treated is a human.

One method of treating hyperglycemia in accordance with the present disclosure comprises the steps of administering the presently disclosed incretin-insulin conjugate to a patient using any standard route of administration, including parenterally, such as intravenously, intraperitoneally, subcutaneously or intramuscularly, intrathecally, transdermally, rectally, orally, nasally or by inhalation. In one embodiment the composition is administered subcutaneously or intramuscularly. In one embodiment, the composition is administered parenterally and the incretin-insulin conjugate is prepackaged in a syringe.

The incretin-insulin conjugate disclosed herein may be administered alone or in combination with other anti-diabetic agents. Anti-diabetic agents known in the art or under investigation include native insulin, native glucagon and functional analogs thereof, sulfonylureas, such as tolbutamide (Orinase), acetohexamide (Dymelor), tolazamide (Tolinase), chlorpropamide (Diabinese), glipizide (Glucotrol), glyburide (Diabeta, Micronase, Glynase), glimepiride (Amaryl), or gliclazide (Diamicron); meglitinides, such as repaglinide (Prandin) or nateglinide (Starlix); biguanides such as metformin (Glucophage) or phenformin; thiazolidinediones such as rosiglitazone (Avandia), pioglitazone (Actos), or troglitazone (Rezulin), or other PPARy inhibitors; alpha glucosidase inhibitors that inhibit carbohydrate digestion, such as miglitol (Glyset), acarbose (Precose/Glucobay); exenatide (Byetta) or pramlintide; Dipeptidyl peptidase-4 (DPP-4) inhibitors such as vildagliptin or sitagliptin; SGLT (sodium-dependent glucose transporter 1) inhibitors; or FBPase (fructose 1,6-bisphosphatase) inhibitors.

Pharmaceutical compositions comprising the incretin-insulin conjugates disclosed herein can be formulated and administered to patients using standard pharmaceutically acceptable carriers and routes of administration known to those skilled in the art. Accordingly, the present disclosure also encompasses pharmaceutical compositions comprising one or more of the incretin-insulin conjugates disclosed herein or a pharmaceutically acceptable salt thereof, in combination with a pharmaceutically acceptable carrier. In one embodiment the pharmaceutical composition comprises a 1 mg/ml concentration of the incretin-insulin conjugate at a pH of about 4.0 to about 7.0 in a phosphate buffer system. The pharmaceutical compositions may comprise the incretin-insulin conjugate as the sole pharmaceutically active component, or the incretin-insulin conjugate peptide can be combined with one or more additional active agents.

All therapeutic methods, pharmaceutical compositions, kits and other similar embodiments described herein contemplate that incretin-insulin conjugate peptides include all pharmaceutically acceptable salts thereof.

In one embodiment the kit is provided with a device for administering the incretin-insulin conjugate to a patient. The kit may further include a variety of containers, e.g., vials, tubes, bottles, and the like. Preferably, the kits will also include instructions for use. In accordance with one embodiment the device of the kit is an aerosol dispensing device, wherein the composition is prepackaged within the aerosol device. In another embodiment the kit comprises a syringe and a needle, and in one embodiment the incretin-insulin conjugate composition is prepackaged within the syringe.

The compounds of this invention may be prepared by standard synthetic methods, recombinant DNA techniques, or any other methods of preparing peptides and fusion proteins. Although certain non-natural amino acids cannot be expressed by standard recombinant DNA techniques, techniques for their preparation are known in the art. Compounds of this invention that encompass non-peptide portions may be synthesized by standard organic chemistry reactions, in addition to standard peptide chemistry reactions when applicable.

Any of the modifications to the incretin peptide or insulin peptide as described above which increase or decrease incretin or insulin receptor activity can be applied individually or in combination. In addition each of the disclosed linear chain spacers disclosed herein can be used in combination with any incretin or insulin to form increlins in accordance with the present disclosure. Any of the modifications described above can also be combined with other modifications that confer other desirable properties, such as increased solubility and/or stability and/or duration of action

EXAMPLE 1

Synthesis of Insulin A & B Chains

Insulin A & B chains were synthesized on 4-methylbenzhyryl amine (MBHA) resin or 4-Hydroxymethyl-phenylacetamidomethyl (PAM) resin using Boc chemistry. The peptides were cleaved from the resin using HF/p-cresol 95:5 for 1 hour at 0° C. Following HF removal and ether precipitation, peptides were dissolved into 50% aqueous acetic acid and lyophilized. Alternatively, peptides were synthesized using Fmoc chemistry. The peptides were cleaved from the resin using Trifluoroacetic acid (TFA)/Triisopropylsilane (TIS)/$H_2O$ (95:2.5:2.5), for 2 hour at room temperature. The peptide was precipitated through the addition of an excessive amount of diethyl ether and the pellet solubilized in aqueous acidic buffer. The quality of peptides were monitored by RP-HPLC and confirmed by Mass Spectrometry (ESI or MALDI).

Insulin A chains were synthesized with a single free cysteine at amino acid 7 and all other cysteines protected as acetamidomethyl A-(SH)$^7$(Acm)$^{6,11,20}$. Insulin B chains were synthesized with a single free cysteine at position 7 and the other cysteine protected as acetamidomethyl B—(SH)$^7$(Acm)$^{19}$. The crude peptides were purified by conventional RP-HPLC.

The synthesized A and B chains were linked to one another through their native disulfide bond linkage as previously disclosed in US-2011-0257076, the disclosure of which is incorporated herein by reference. The respective B chain was activated to the Cys$^7$-Npys derivative through dissolution in DMF or DMSO and reacted with 2,2'-Dithiobis (5-nitropyridine) (Npys) at a 1:1 molar ratio, at room temperature. The activation was monitored by RP-HPLC and the product was confirmed by ESI-MS.

The first B7-A7 disulfide bond was formed by dissolution of the respective A-(SH)$^7$(Acm)$^{6,11,20}$ and B-(Npys)$^7$(Acm)$^{19}$ at 1:1 molar ratio to a total peptide concentration of 10 mg/ml. When the chain combination reaction was complete the mixture was diluted to a concentration of 50% aqueous acetic acid. The last two disulfide bonds were formed simultaneously through the addition of iodine. A 40 fold molar excess of iodine was added to the solution and the mixture was stirred at room temperature for an additional hour. The reaction was terminated by the addition of an aqueous ascorbic acid solution. The mixture was purified by RP-HPLC and the final compound was confirmed by MALDI-MS. As shown in the data in Table 1, the synthetic insulin prepared in accordance with this procedure compares well with purified insulin for insulin receptor binding.

Insulin peptides comprising a modified amino acid (such as 4-amino phenylalanine at position A19) can also be synthesized in vivo using a system that allows for incorporation of non-coded amino acids into proteins, including for example, the system taught in U.S. Pat. Nos. 7,045,337 and 7,083,970.

TABLE 1

Activity of synthesized insulin relative to native insulin

| | Insulin Standard | | A7-B7 Insulin | |
| --- | --- | --- | --- | --- |
| | AVER. | STDEV | AVER. | STDEV |
| $IC_{50}$(nM) | 0.24 | 0.07 | 0.13 | 0.08 |
| % of Insulin Activity | 100 | | 176.9 | |

EXAMPLE 2

Pegylation of Amine Groups (N-Terminus and Lysine) by Reductive Alkylation a. Synthesis Insulin (or an insulin analog), mPEG20 k—Aldyhyde, and NaBH$_3$CN, in a molar ratio of 1:2:30, were dissolved in acetic acid buffer at a pH of 4.1-4.4. The reaction solution was composed of 0.1 N NaCl, 0.2 N acetic acid and 0.1 N Na$_2$CO$_3$. The insulin peptide concentration was approximately 0.5 mg/ml. The reaction occurs over six hours at room temperature. The degree of reaction was monitored by RP-HPLC and the yield of the reaction was approximately 50%.

b. Purification

The reaction mixture was diluted 2-5 fold with 0.1% TFA and applied to a preparative RP-HPLC column. HPLC condition: C4 column; flow rate 10 ml/min; A buffer 10% ACN and 0.1% TFA in water; B buffer 0.1% TFA in ACN; A linear gradient B % from 0-40% (0-80 min); PEG-insulin or analogues was eluted at approximately 35% buffer B. The desired compounds were verified by MALDI-TOF, following chemical modification through sulftolysis or trypsin degradation.

Pegylation of Amine Groups (N-Terminus and Lysine) by N-Hydroxysuccinimide Acylation.

a. Synthesis

Insulin (or an insulin analog) along with mPEG20 k—NHS were dissolved in 0.1 N Bicine buffer (pH 8.0) at a molar ratio of 1:1. The insulin peptide concentration was approximately 0.5 mg/ml. Reaction progress was monitored by HPLC. The yield of the reaction is approximately 90% after 2 hours at room temperature.

b. Purification

The reaction mixture was diluted 2-5 fold and loaded to RP-HPLC.

HPLC condition: C4 column; flow rate 10 ml/min; A buffer 10% ACN and 0.1% TFA in water; B buffer 0.1% TFA in ACN; A linear gradient B % from 0-40% (0-80 min); PEG-insulin or analogues was collected at approximately 35% B. The desired compounds were verified by MAIDI-TOF, following chemical modification through sulftolysis or trypsin degradation.

Reductive Aminated Pegylation of Acetyl Group on the Aromatic Ring of the Phenylalanine a. Synthesis Insulin (or an insulin analogue), mPEG20 k-Hydrazide, and NaBH$_3$CN in a molar ratio of 1:2:20 were dissolved in acetic acid buffer (pH of 4.1 to 4.4). The reaction solution was composed of 0.1 N NaCl, 0.2 N acetic acid and 0.1 N Na$_2$CO$_3$. Insulin or insulin analogue concentration was approximately 0.5 mg/ml. at room temperature for 24 h. The reaction process was monitored by HPLC. The conversion of the reaction was approximately 50%. (calculated by HPLC)

b. Purification

The reaction mixture was diluted 2-5 fold and loaded to RP-HPLC.

HPLC condition: C4 column; flow rate 10 ml/min; A buffer 10% ACN and 0.1% TFA in water; B buffer 0.1% TFA in ACN; A linear gradient B % from 0-40% (0-80 min); PEG-insulin, or the PEG-insulin analogue was collected at approximately 35% B. The desired compounds were verified by MAIDI-TOF, following chemical modification through sulftolysis or trypsin degradation.

EXAMPLE 3

Incretin General Synthesis Protocol:

Glucagon analogs were synthesized using HBTU-activated "Fast Boc" single coupling starting from 0.2 mmole of Boc Thr(OBzl)Pam resin on a modified Applied Biosystem 430 A peptide synthesizer. Boc amino acids and HBTU were obtained from Midwest Biotech (Fishers, Ind.). Side chain protecting groups used were: Arg(Tos), Asn(Xan), Asp(O-cHex), Cys(pMeBzl), His(Bom), Lys(2Cl—Z), Ser(OBzl), Thr(OBzl), Tyr(2Br—Z), and Trp(CHO). The side-chain protecting group on the N-terminal His was Boc.

Each completed peptidyl resin was treated with a solution of 20% piperdine in dimethylformamide to remove the formyl group from the tryptophan. Liquid hydrogen fluoride cleavages were performed in the presence of p-cresol and dimethyl sulfide. The cleavage was run for 1 hour in an ice bath using an HF apparatus (Penninsula Labs). After evaporation of the HF, the residue was suspended in diethyl ether and the solid materials were filtered. Each peptide was extracted into 30-70 ml aqueous acetic acid and a diluted aliquot was analyzed by HPLC [Beckman System Gold, 0.46×5 cm Zorbax C8, 1 ml/min, 45 C, 214 nm, A buffer=0.1% TFA, B=0.1% TFA/90% acetonitrile, gradient of 10% to 80% B over 10 min].

Purification was done on a FPLC over a 2.2×25 cm Kromasil C18 column while monitoring the UV at 214 nm and collecting 5 minute fractions. The homogeneous fractions were combined and lyophilized to give a product purity of >95%. The correct molecular mass and purity were confirmed using MALDI-mass spectral analysis.

EXAMPLE 4

General Incretin Pegylation Protocol: (Cys-maleimido)

Typically, the glucagon Cys analog is dissolved in phosphate buffered saline (5-10 mg/ml) and 0.01M ethylenediamine tetraacetic acid is added (10-15% of total volume). Excess (2-fold) maleimido methoxyPEG reagent (Nektar) is added and the reaction stirred at room temp while monitoring reaction progress by HPLC. After 8-24 hrs, the reaction mixture, is acidified and loaded onto a preparative reverse phase column for purification using 0.1% TFA/acetonitrile gradient. The appropriate fractions were combined and lyophilized to give the desired pegylated analogs.

EXAMPLE 5

Synthesis of Glucagon-Cex and Other C-Terminal Extended Analogs.

285 mg (0.2 mmole) methoxybenzhydrylamine resin (Midwest Biotech) was placed in a 60 ml reaction vessel and the following sequence was entered and run on a modified Applied Biosystems 430A peptide synthesizer using Fast-Boc HBTU-activated single couplings.

HSQGTFTSDYSKYLDSRRAQDFVQWLMNTGPSS-GAPPPS (SEQ ID NO: 1948) The following side chain protecting groups were used: Arg(Tos), Asp(OcHex), Asn (Xan), Cys(pMeBzl), Glu(OcHex), His(Boc), Lys(2Cl—Z), Ser(Bzl), Thr(Bzl), Trp(CHO), and Tyr(Br—Z). The completed peptidyl resin was treated with 20% piperidine/dimethylformamide to remove the Trp formyl protection then transferred to HF reaction vessel and dried in vacuo. 1.0 ml p-cresol and 0.5 ml dimethyl sulfide were added along with a magnetic stir bar. The vessel was attached to the HF apparatus (Penninsula Labs), cooled in a dry ice/methanol bath, evacuated, and aprox. 10 ml liquid hydrogen fluoride was condensed in. The reaction was stirred in an ice bath for 1 hr then the HF was removed in vacuo. The residue was suspended in ethyl ether; the solids were filtered, washed with ether, and the peptide extracted into 50 ml aqueous acetic acid. An analytical HPLC was run [0.46×5 cm Zorbax C8, 1 ml/min, 45 C, 214 nm, A buffer of 0.1% TFA, B buffer of 0.1% TFA/90% ACN, gradient=10% B to 80% B over 10 min.] on an aliquot of the cleavage extract. The extract was loaded onto a 2.2×25 cm Kromasil C18 preparative reverse phase column and an acetonitrile gradient was run for elution using a Pharmacia FPLC system. 5 min fractions were collected while monitoring the UV at 214 nm (2.0 A). A=0.1% TFA, B=0.1% TFA/50% acetonitrile. Gradient=30% B to 100% B over 450 min. Fractions 58-65 were combined, frozen and lyophilized to give 198.1 mg.

HPLC analysis of the product showed a purity of greater than 95%. MALDI mass spectral analysis showed the presence of the desired theoretical mass of 4316.7 with the product as a C-terminal amide. Oxyntomodulin and oxyntomodulin-KRNR were similarly prepared as the C-terminal carboxylic acids starting with the appropriately loaded PAM-resin.

EXAMPLE 6

Synthesis of Glucagon Lactams 285 mg (0.2 mmole) methoxybenzhydrylamine resin (Midwest Biotech) was added to a 60 mL reaction vessels and the following sequence was assembled on a modified Applied Biosystems 430A peptide synthesizer using Boc DEPBT-activated single couplings.

HSQGTFTSDYSKYLDERRAQDFVQWLMNT-NH2 (12-16 Lactam; SEQ ID NO: 100).

The following side chain protecting groups were used: Arg(Tos), Asp(OcHx), Asn(Xan), Glu(OFm), His(BOM), Lys(Fmoc), Ser(Bzl), Thr(Bzl), Trp(CHO), Tyr(Br—Z). Lys (Cl—Z) was used at position 12 if lactams were constructed from 16-20, 20-24, or 24-28. The completed peptidyl resin was treated with 20% piperidine/dimethylformamide for one hour with rotation to remove the Trp formyl group as well as the Fmoc and OFm protection from Lys12 and Glu16. Upon confirmation of removal by a positive ninhydrin test, the resin was washed with dimethylformamide, followed by dichloromethane and then again with dimethylformamide. The resin was treated with 520 mg (1 mmole) Benzotriazole-1-yl-oxy-tris-pyrrolidino-phosphonium hexafluorophosphate (PyBOP) in dimethylformamide and diisopropylethylamine (DIEA). The reaction proceeded for 8-10 hours and the cyclization was confirmed by a negative ninhydrin reaction. The resin was washed with dimethylformamide, followed by dichloromethane and subsequently treated with trifluoroacetic acid for 10 minutes. The removal of the Boc group was confirmed by a positive ninhydrin reaction. The resin was washed with dimethylformamide and dichloromethane and dried before being transferred to a hydrofluoric acid (HF) reaction vessel. 500 µL p-cresol was added along with a magnetic stir bar. The vessel was attached to the HF apparatus (Peninsula Labs), cooled in a dry ice/methanol bath, evacuated, and approximately 10 mL of liquid hydrofluoric acid was condensed into the vessel. The reaction was stirred for 1 hour in an ice bath and the HF was subsequently removed in vacuo. The residue was suspended in ethyl ether; the solids were filtered, washed with ether, and the peptide was solubilized with 150 mL 20% acetonitrile/1% acetic acid.

An analytical HPLC analysis of the crude solubilized peptide was conducted under the following conditions [4.6× 30 mm Xterra C8, 1.50 mL/min, 220 nm, A buffer 0.1% TFA/10% ACN, B buffer 0.1% TFA/100% ACN, gradient 5-95% B over 15 minutes]. The extract was diluted twofold with water and loaded onto a 2.2×25 cm Vydac C4 preparative reverse phase column and eluted using an acetonitrile gradient on a Waters HPLC system (A buffer of 0.1% TFA/10% ACN, B buffer of 0.1% TFA/10% CAN and a gradient of 0-100% B over 120 minutes at a flow of 15.00 ml/min. HPLC analysis of the purified peptide demonstrated greater than 95% purity and electrospray ionization mass spectral analysis confirmed a mass of 3506 Da for the 12-16 lactam. Lactams from 16-20, 20-24, and 24-28 were prepared similarly.

EXAMPLE 7

Preparation of Acylated and/or PEGylated Peptides

Acylated and/or PEGylated peptides are prepared as follows. Peptides are synthesized on a solid support resin using either a CS Bio 4886 Peptide Synthesizer or Applied Biosystems 430A Peptide Synthesizer. In situ neutralization chemistry is used as described by Schnolzer et al., *Int. J. Peptide Protein Res.* 40: 180-193 (1992). For acylated peptides, the target amino acid residue to be acylated (e.g., position ten) is substituted with an N ε-FMOC lysine residue. Treatment of the completed N-terminally BOC protected peptide with 20% piperidine in DMF for 30 minutes removes FMOC/formyl groups. Coupling to the free ε-amino Lys residue is achieved by coupling a ten-fold molar excess of either an FMOC-protected spacer amino acid (ex. FMOC—(N—BOC)-Tryptophan-OH) or acyl chain (ex. C17-COOH) and PyBOP or DEPBT coupling reagent in DMF/DIEA. Subsequent removal of the spacer amino acid's FMOC group is followed by repetition of coupling with an acyl chain. Final treatment with 100% TFA results in removal of any side chain protecting groups and the N-terminal BOC group. Peptide resins are neutralized with 5% DIEA/DMF, are dried, and then are cleaved from the support using HF/p-cresol, 95:5, at 0° C. for one hour. Following ether extraction, a 5% HOAc solution is used to solvate the crude peptide. A sample of the solution is then verified to contain the correct molecular weight peptide by ESI-MS. Correct peptides are purified by RP-HPLC using a linear gradient of 10% CH3CN/0.1% TFA to 0.1% TFA in 100% CH3CN. A Vydac C18 22 mm×250 mm protein column is used for the purification. Acylated peptide analogs generally complete elution by a buffer ratio of 20:80. Portions are pooled together and checked for purity on an analytical RP-HPLC. Pure fractions are lyophilized yielding white, solid peptides.

If a peptide comprises a lactam bridge and target residues to be acylated, acylation is carried out as described above upon addition of that amino acid to the peptide backbone.

For peptide pegylation, 40 kDa methoxy poly(ethylene glycol) maleimido-propionamide (Chirotech Technology Ltd.) is reacted with a molar equivalent of peptide in 7M Urea, 50 mM Tris-HCl buffer using the minimal amount of solvent needed to dissolve both peptide and PEG into a clear solution (generally less than 2 mL for a reaction using 2-3 mg peptide). Vigorous stirring at room temperature commences for 4-6 hours and the reaction is analyzed by analytical RP-HPLC. PEGylated products appear distinctly from the starting material with decreased retention times. Purification is performed on a Vydac C4 column with conditions similar to those used for the initial peptide purification. Elution typically occurs around buffer ratios of 50:50. Fractions of pure PEGylated peptide are collected and lyophilized.

Peptides are assayed for biological activity as described above in Example 16. Acylated peptides may exhibit increased potency at the GLP-1 receptor. Inclusion of a tryptophan spacer may provide better potency at the glucagon receptor.

While acylation can extend the half-life of a peptide to hours or more, PEGylation with repeats in tens of kDa ranges can do even more. Peptides comprising both types of modifications are prepared. These peptides are expected to exhibit extended half-life in circulation, as well as resistance to DPP-IV and other proteases.

EXAMPLE 8

Glucagon Receptor Binding Assay

The affinity of peptides to the glucagon receptor was measured in a competition binding assay utilizing scintillation proximity assay technology. Serial 3-fold dilutions of the peptides made in scintillation proximity assay buffer (0.05 M Tris-HCl, pH 7.5, 0.15 M NaCl, 0.1% w/v bovine serum albumin) were mixed in 96 well white/clear bottom plate (Corning Inc., Acton, Mass.) with 0.05 nM (3-[$^{125}$I]-iodotyrosyl) Tyr10 glucagon (Amersham Biosciences, Piscataway, N.J.), 1-6 micrograms per well, plasma membrane fragments prepared from cells over-expressing human glucagon receptor, and 1 mg/well polyethyleneimine-treated wheat germ agglutinin type A scintillation proximity assay beads (Amersham Biosciences, Piscataway, N.J.). Upon 5 min shaking at 800 rpm on a rotary shaker, the plate was incubated 12 h at room temperature and then read on MicroBeta1450 liquid scintillation counter (Perkin-Elmer, Wellesley, Mass.). Non-specifically bound (NSB) radioactivity was measured in the wells with 4 times greater concentration of "cold" native ligand than the highest concentration in test samples and total bound radioactivity was detected in the wells with no competitor. Percent specific binding was calculated as following: % Specific Binding= ((Bound−NSB)/(Total bound−NSB))×100. $IC_{50}$ values were determined by using Origin software (OriginLab, Northampton, Mass.).

EXAMPLE 9

Functional Assay-cAMP Synthesis

The ability of glucagon analogs to induce cAMP was measured in a firefly luciferase-based reporter assay. HEK293 cells co-transfected with a receptor (glucagon receptor, GLP-1 receptor or GIP receptor) and luciferase gene linked to cAMP responsive element were serum deprived by culturing 16 h in DMEM (Invitrogen, Carlsbad, Calif.) supplemented with 0.25% Bovine Growth Serum (HyClone, Logan, Utah) and then incubated with serial dilutions of either glucagon, GLP-1, GIP or novel glucagon analogs for 5 h at 37° C., 5% $CO_2$ in 96 well poly-D-Lysine-coated "Biocoat" plates (BD Biosciences, San Jose, Calif.). At the end of the incubation 100 microliters of LucLite luminescence substrate reagent (Perkin-Elmer, Wellesley, Mass.) were added to each well. The plate was shaken briefly, incubated 10 min in the dark and light output was measured on MicroBeta-1450 liquid scintillation counter (Perkin-Elmer, Wellesley, Mass.). Effective 50% concentrations were calculated by using Origin software (OriginLab, Northampton, Mass.

EXAMPLE 10

Insulin Receptor Binding Assay:

The affinity of each peptide for the insulin or IGF-1 receptor was measured in a competition binding assay utilizing scintillation proximity technology. Serial 3-fold dilutions of the peptides were made in Tris-C1 buffer (0.05 M Tris-HCl, pH 7.5, 0.15 M NaCl, 0.1% w/v bovine serum albumin) and mixed in 96 well plates (Corning Inc., Acton, Mass.) with 0.05 nM (3-[125I]-iodotyrosyl) A TyrA14 insulin or (3-[125I]-iodotyrosyl) IGF-1 (Amersham Biosciences, Piscataway, N.J.). An aliquot of 1-6 micrograms of plasma membrane fragments prepared from cells over-expressing the human insulin or IGF-1 receptors were present in each well and 0.25 mg/well polyethylene imine-treated wheat germ agglutinin type A scintillation proximity assay beads (Amersham Biosciences, Piscataway, N.J.) were added. After five minutes of shaking at 800 rpm the plate was incubated for 12 h at room temperature and radioactivity was measured with MicroBeta1450 liquid scintillation counter (Perkin-Elmer, Wellesley, Mass.). Non-specifically bound (NSB) radioactivity was measured in the wells with a four-fold concentration excess of "cold" native ligand than the highest concentration in test samples. Total bound radioactivity was detected in the wells with no competitor. Percent specific binding was calculated as following: % Specific Binding=(Bound−NSB/Total bound−NSB)×100. IC50 values were determined by using Origin software (OriginLab, Northampton, Mass.).

EXAMPLE 11

Insulin Receptor Phosphorylation Assay:

To measure receptor phosphorylation of insulin or insulin analog, receptor transfected HEK293 cells were plated in 96 well tissue culture plates (Costar #3596, Cambridge, Mass.) and cultured in Dulbecco's modified Eagle medium (DMEM) supplemented with 100 IU/ml penicillin, 100 µg/ml streptomycin, 10 mM HEPES and 0.25% bovine growth serum (HyClone SH30541, Logan, Utah) for 16-20 hrs at 37° C., 5% $CO_2$ and 90% humidity. Serial dilutions of insulin or insulin analogs were prepared in DMEM supplemented with 0.5% bovine serum albumin (Roche Applied Science #100350, Indianapolis, Ind.) and added to the wells with adhered cells. After 15 min incubation at 37° C. in humidified atmosphere with 5% $CO_2$ the cells were fixed with 5% paraformaldehyde for 20 min at room temperature, washed twice with phosphate buffered saline pH 7.4 and blocked with 2% bovine serum albumin in PBS for 1 hr. The plate was then washed three times and filled with horseradish peroxidase-conjugated antibody against phosphotyrosine (Upstate biotechnology #16-105, Temecula, Calif.) reconstituted in PBS with 2% bovine serum albumin per manufacturer's recommendation. After 3 hrs incubation at room temperature the plate was washed 4 times and 0.1 ml of TMB single solution substrate (Invitrogen, #00-2023, Carlbad, Calif.) was added to each well. Color development was stopped 5 min later by adding 0.05 ml 1 N HCl. Absorbance at 450 nm was measured on Titertek Multiscan MCC340 (ThermoFisher, Pittsburgh, Pa.). Absorbance vs. peptide concentration dose response curves were plotted and $EC_{50}$ values were determined by using Origin software (OriginLab, Northampton, Mass.).

EXAMPLE 12

Synthetic Procedures for Incretin-Insulin Fusions (Increlins)

Figure 4A:
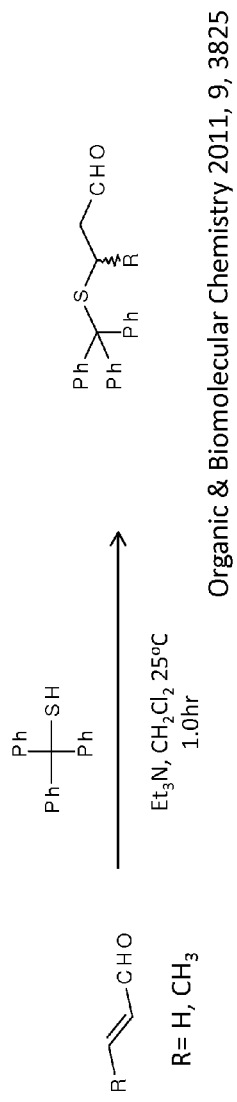

Scheme 1 as shown in FIG. 4A provides the procedure for the synthesis of the aldehyde linker. The reaction involves a single step Michael addition of triphenylmethylthiol to acrolein (see Org. Biomol. Chem. 2011, 9, 3825). The reaction proceeds in 85-90% yield with the product recovered by solvent evaporation, followed by trituration with hexane. The material is then recrystallized from ethyl acetate/hexane and is stable for storage at room temperature.

Figure 4B:
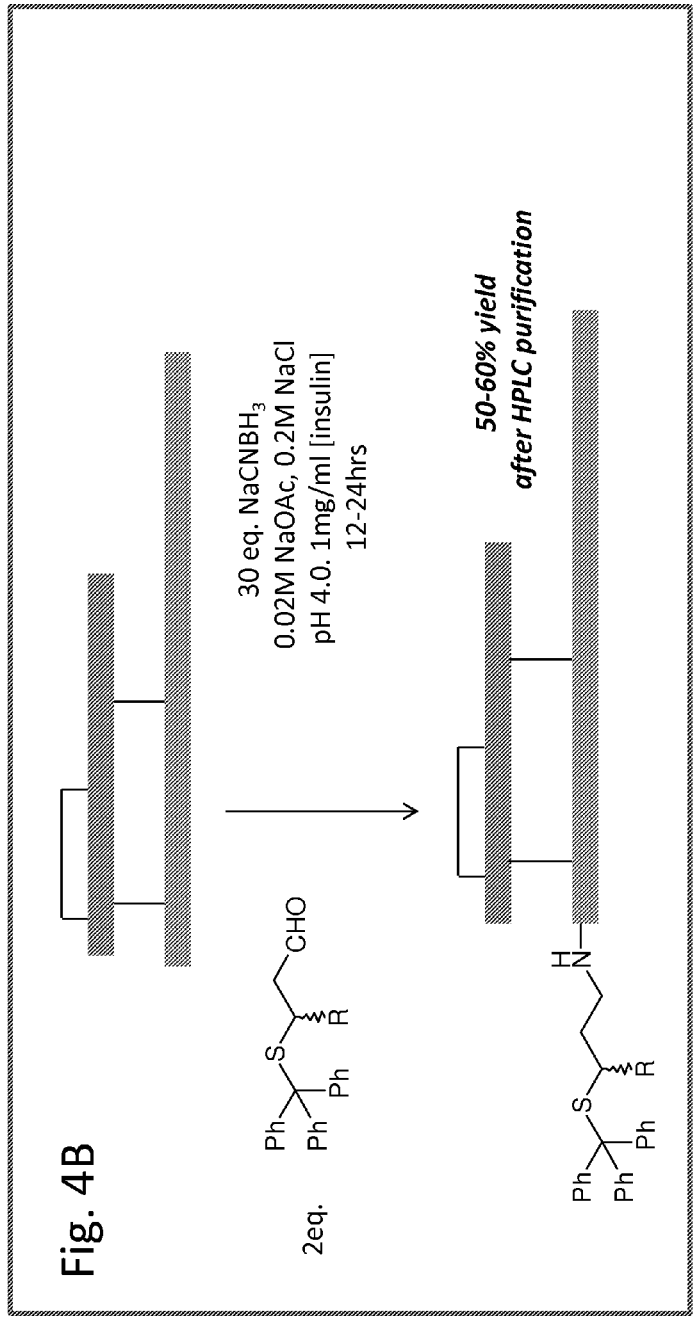
Figure 5A:
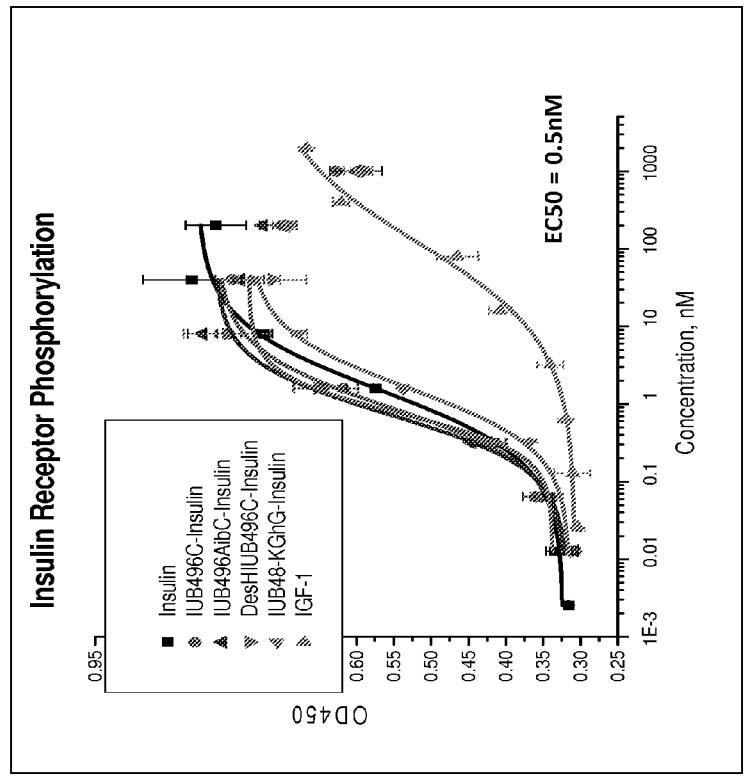
FIGS. 5A & 5B are graphs demonstrating the in vitro activity of a GLP-1/insulin fusion peptide (IUB48, SEQ ID NO: 1932) FIG. 5A) and a glucagon/insulin fusion peptide (IUB496, SEQ ID NO: 521.
Figure 5B:
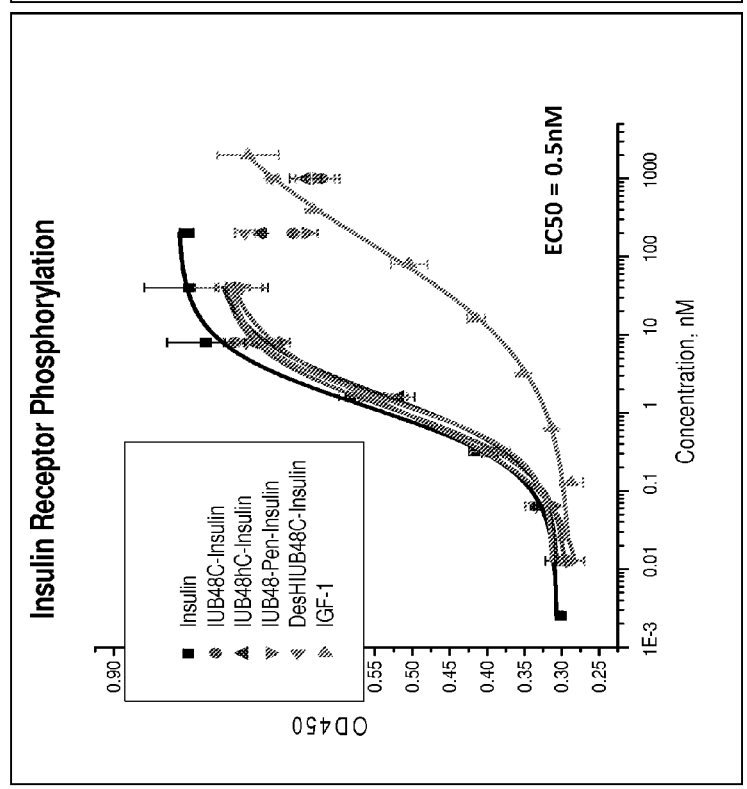
Figure 9A:
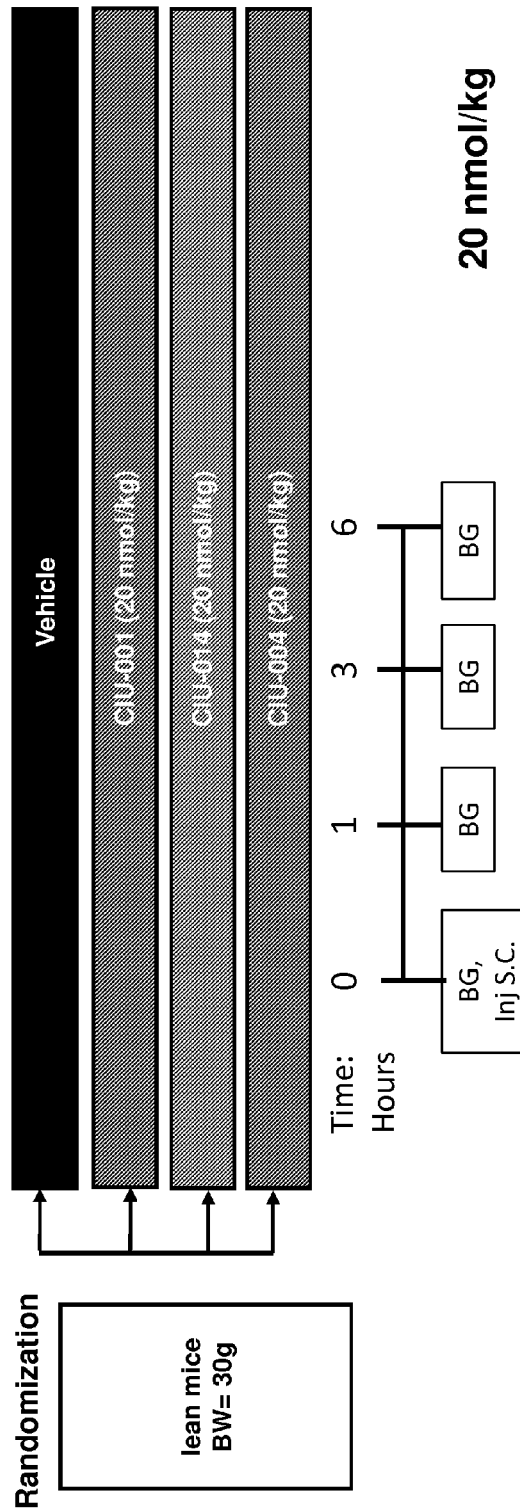
FIGS. 9A-9B provide the results of an experiment conducted on normal mice administered a 20 nmoles/kg dose of an incretin-insulin conjugate, wherein either the incretin or the insulin component has been modified to eliminate either GLP-1 or insulin peptide activity.
Figure 9B:
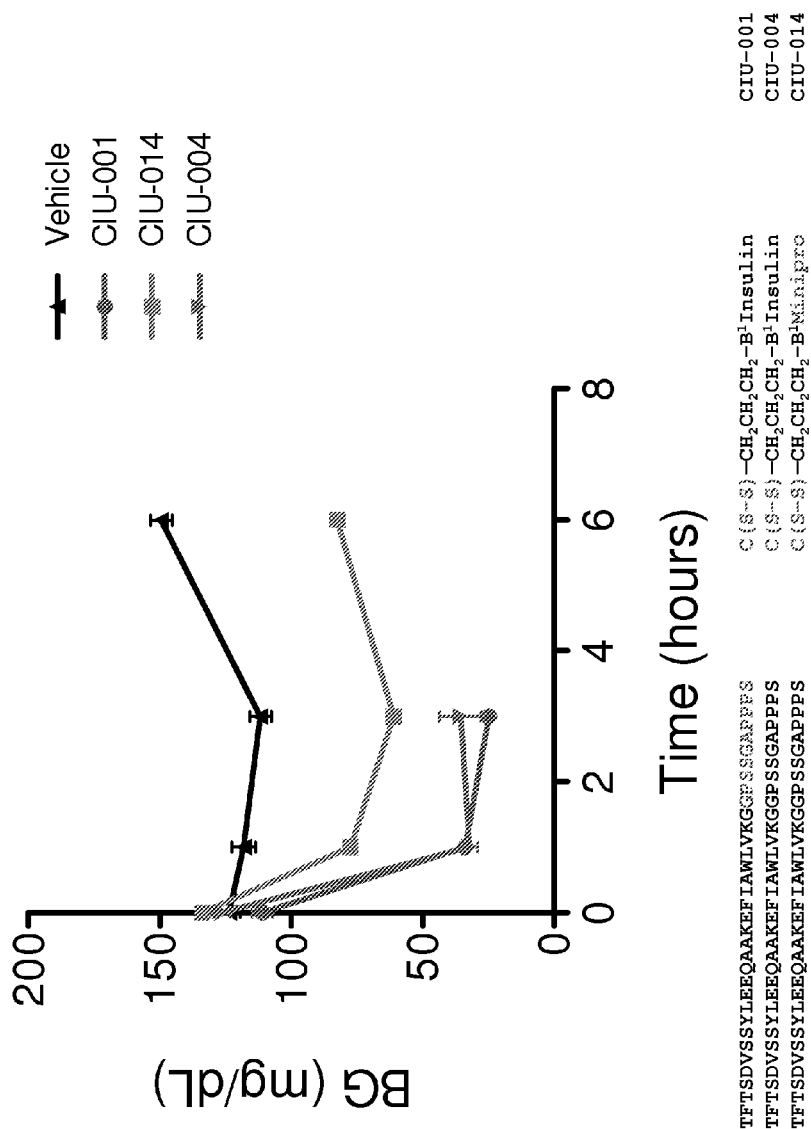
Figure 11C:
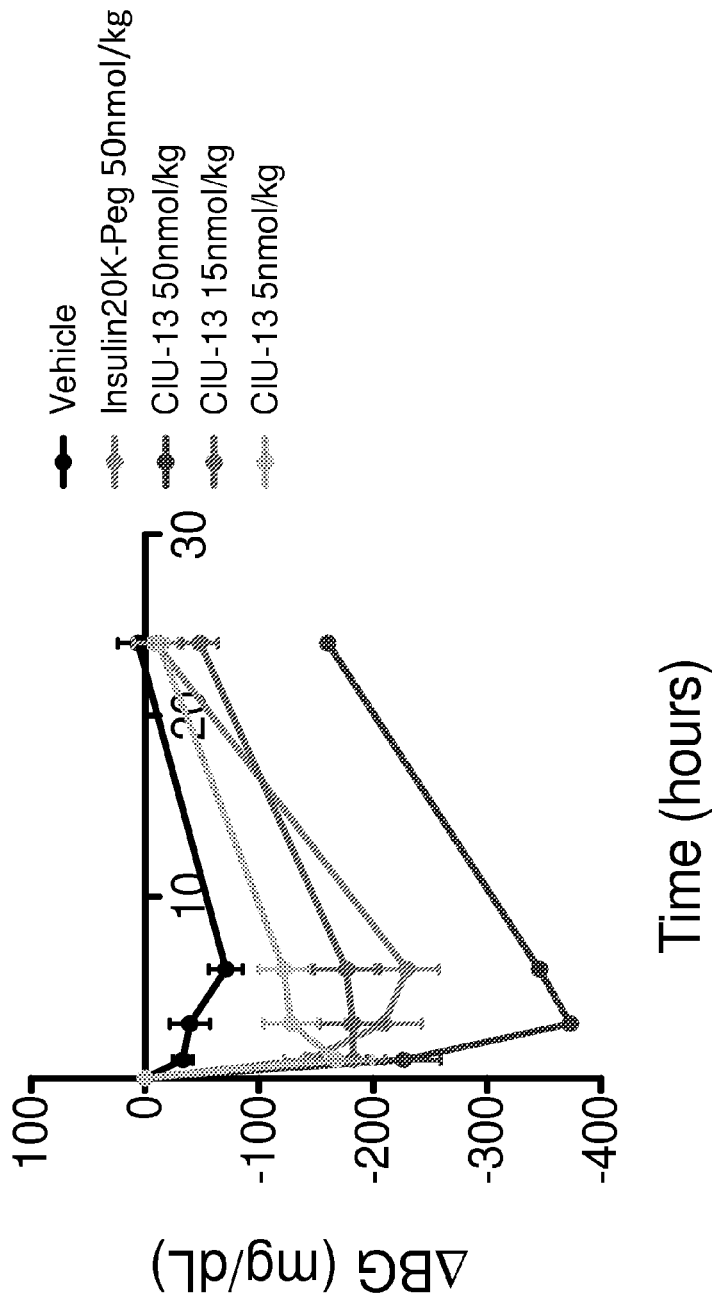
FIG. 11C is a graph measuring initial blood glucose levels and the change in blood glucose after administration of the compound. Both FIGS. 11B and 11C demonstrate the lipidated incretin-insulin conjugates are very potent compounds.
Figure 14C:
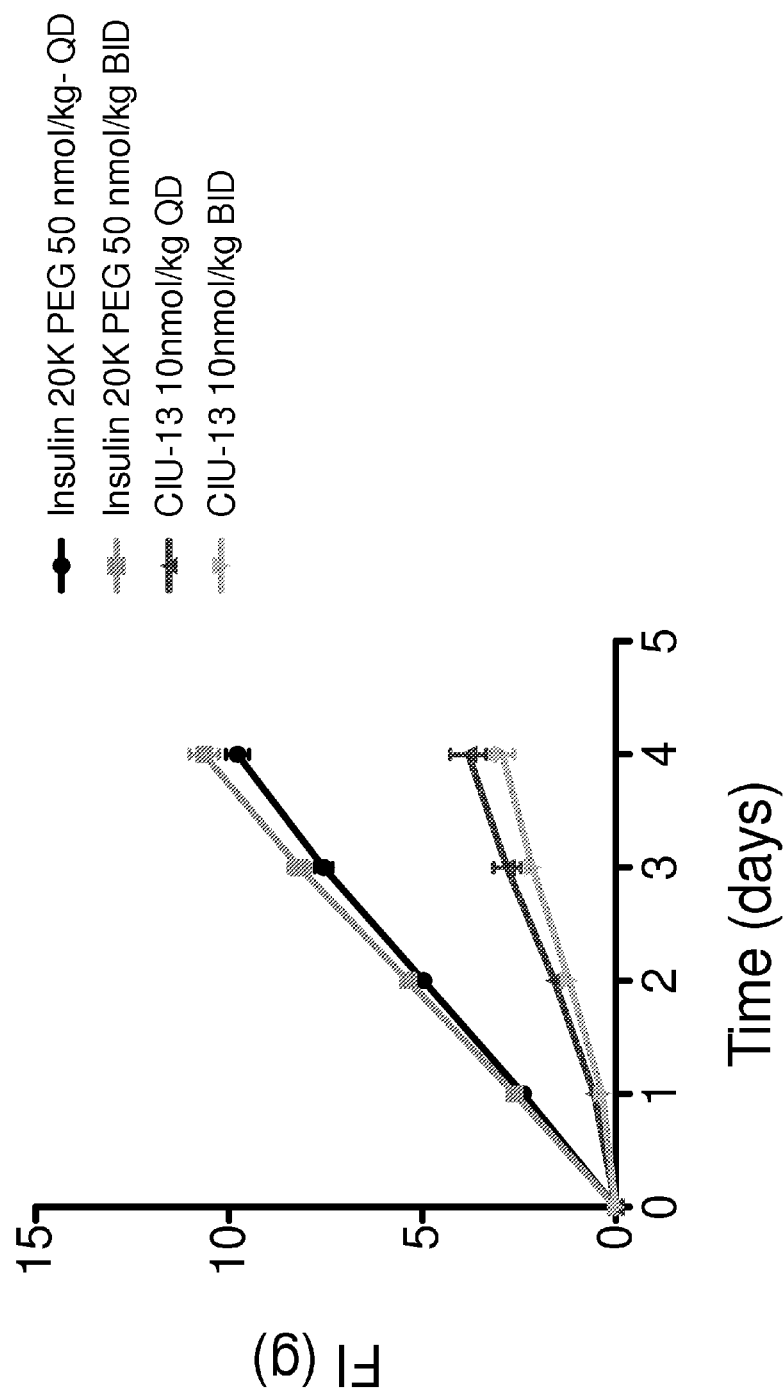
Figure 14D:
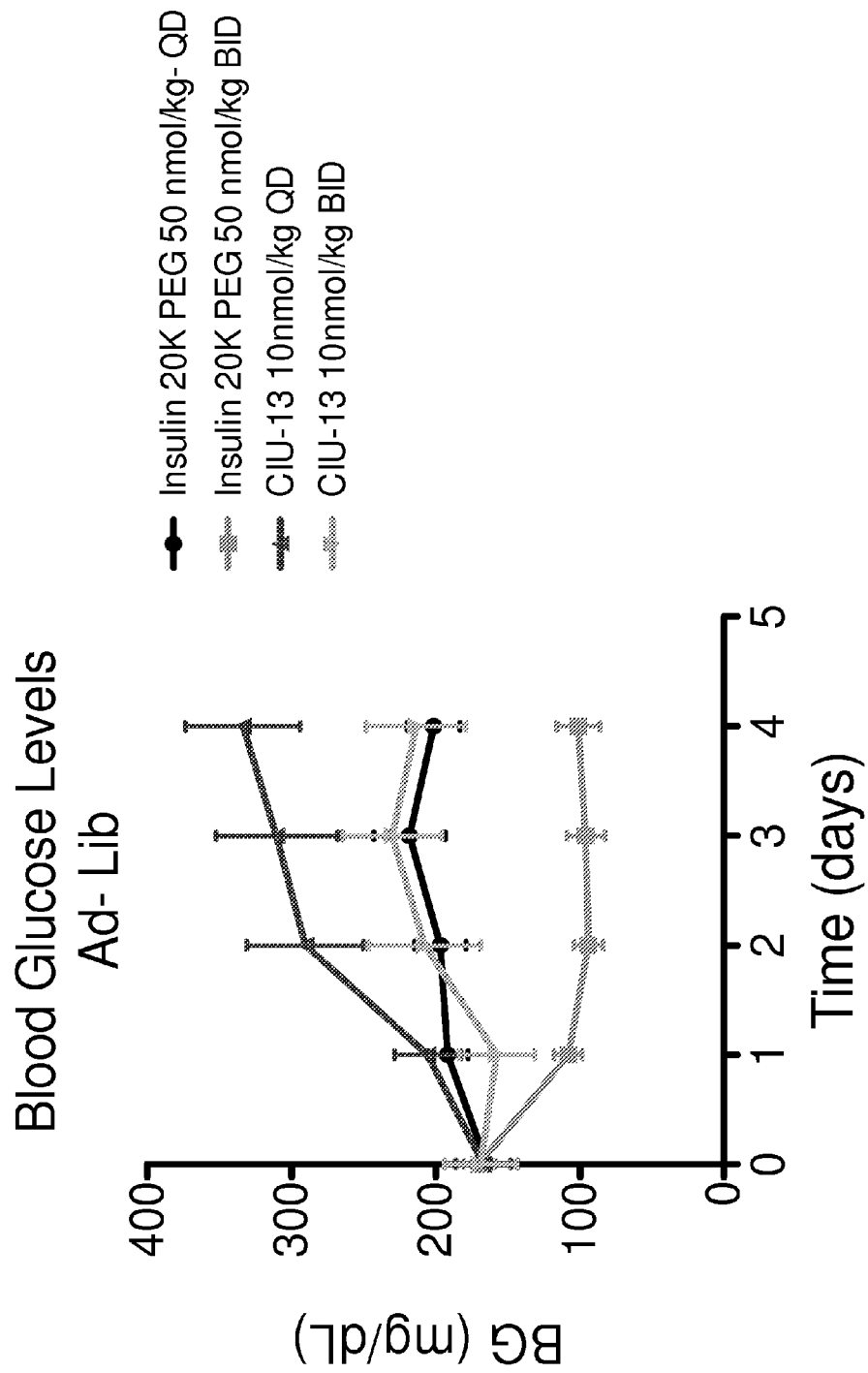
Figure 15A:
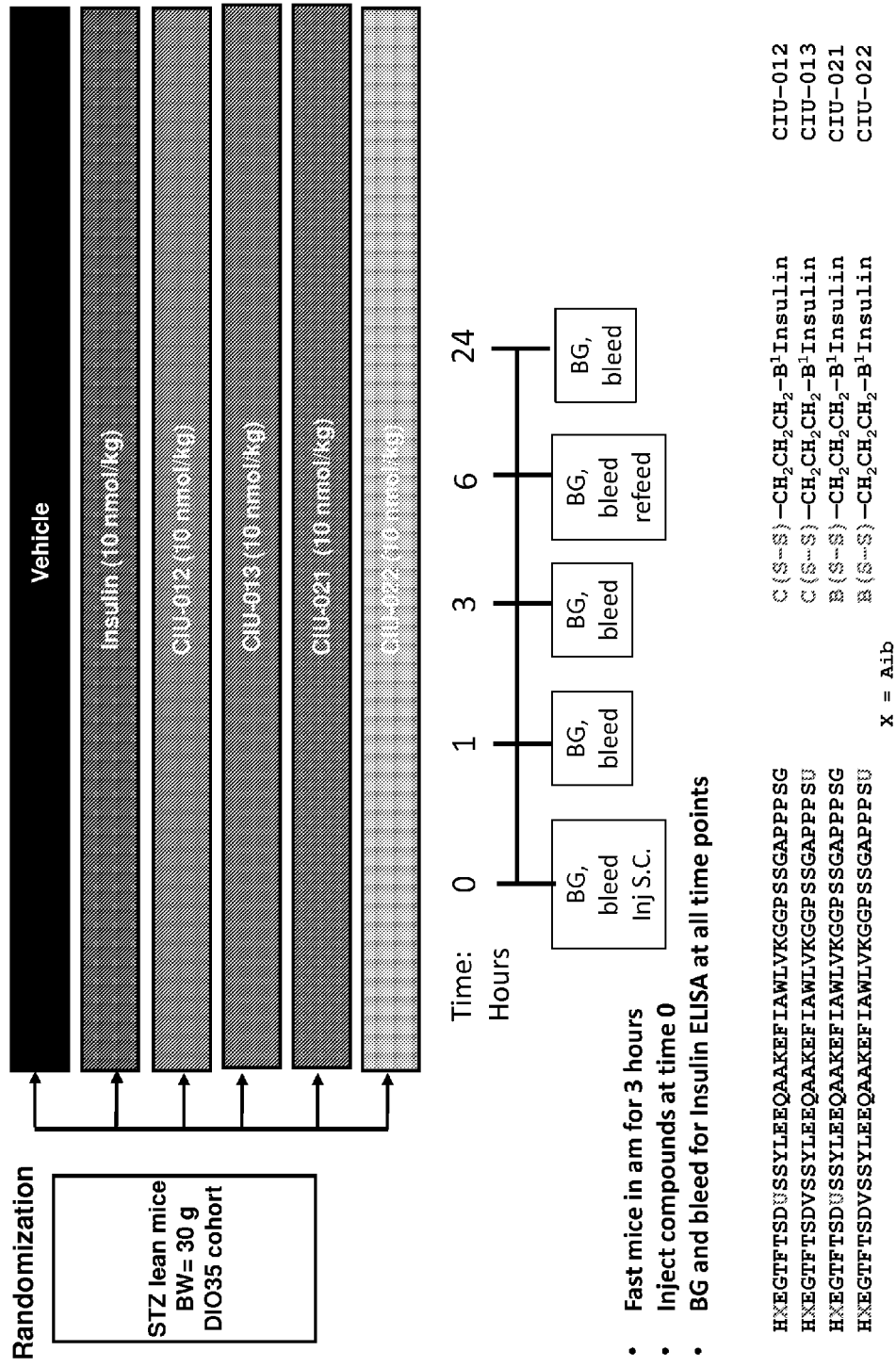
Figure 15C:
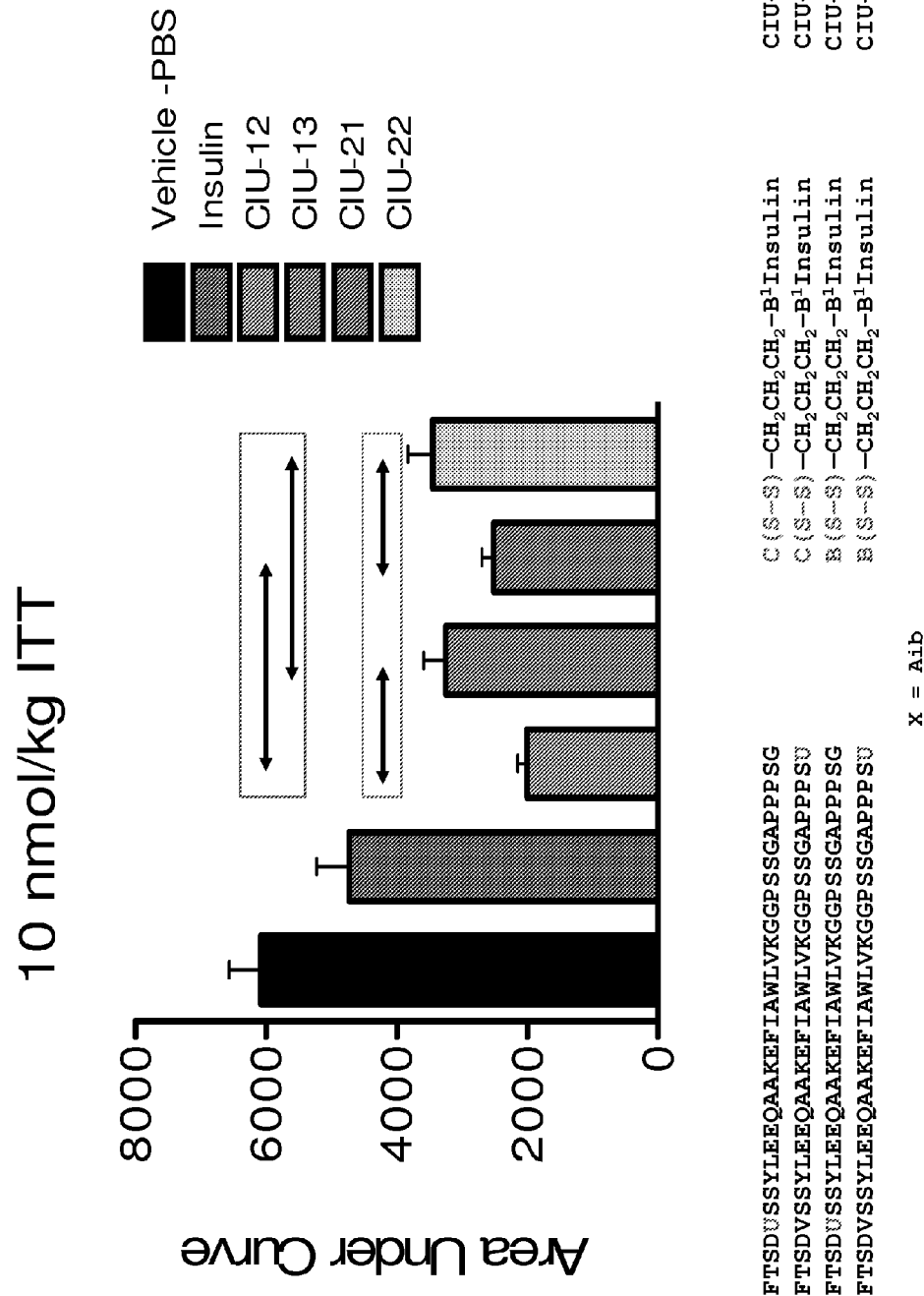
Figure 16B:
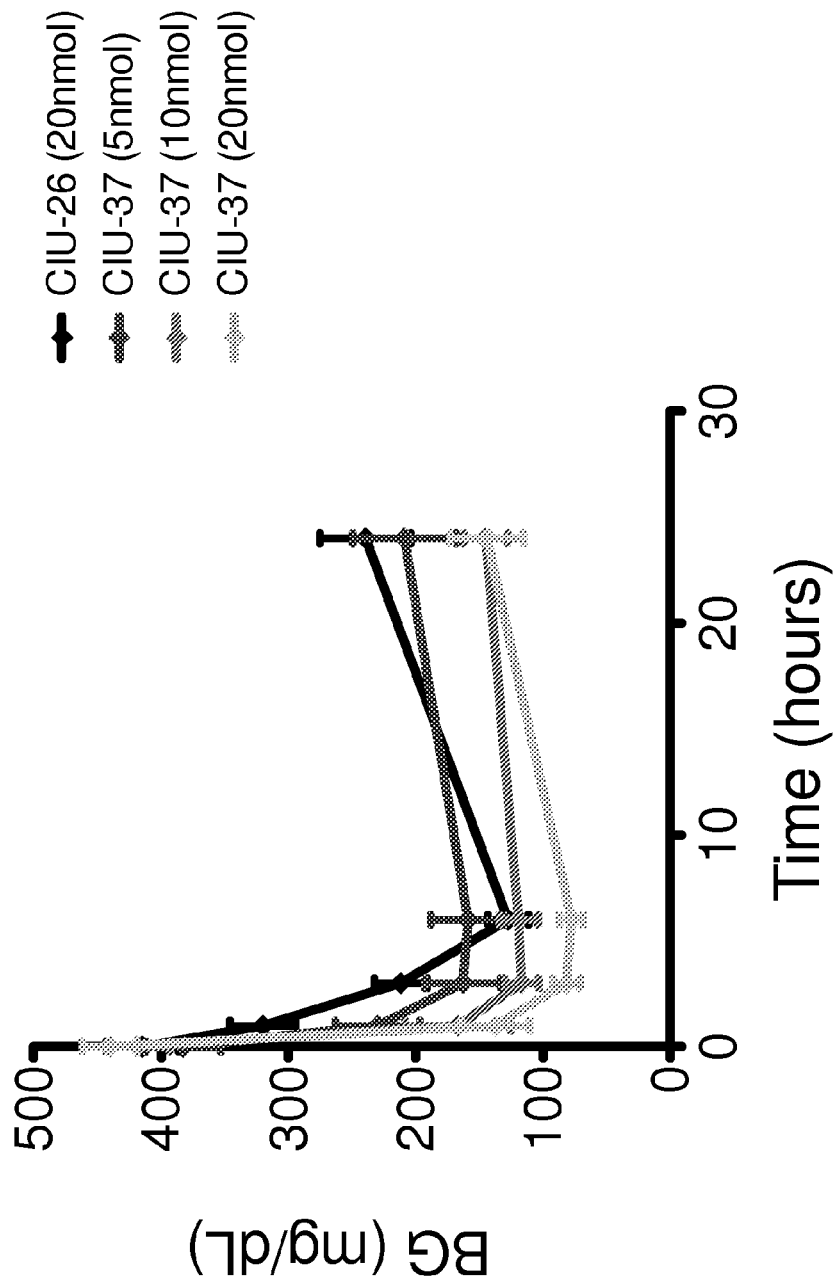
Figure 16C:
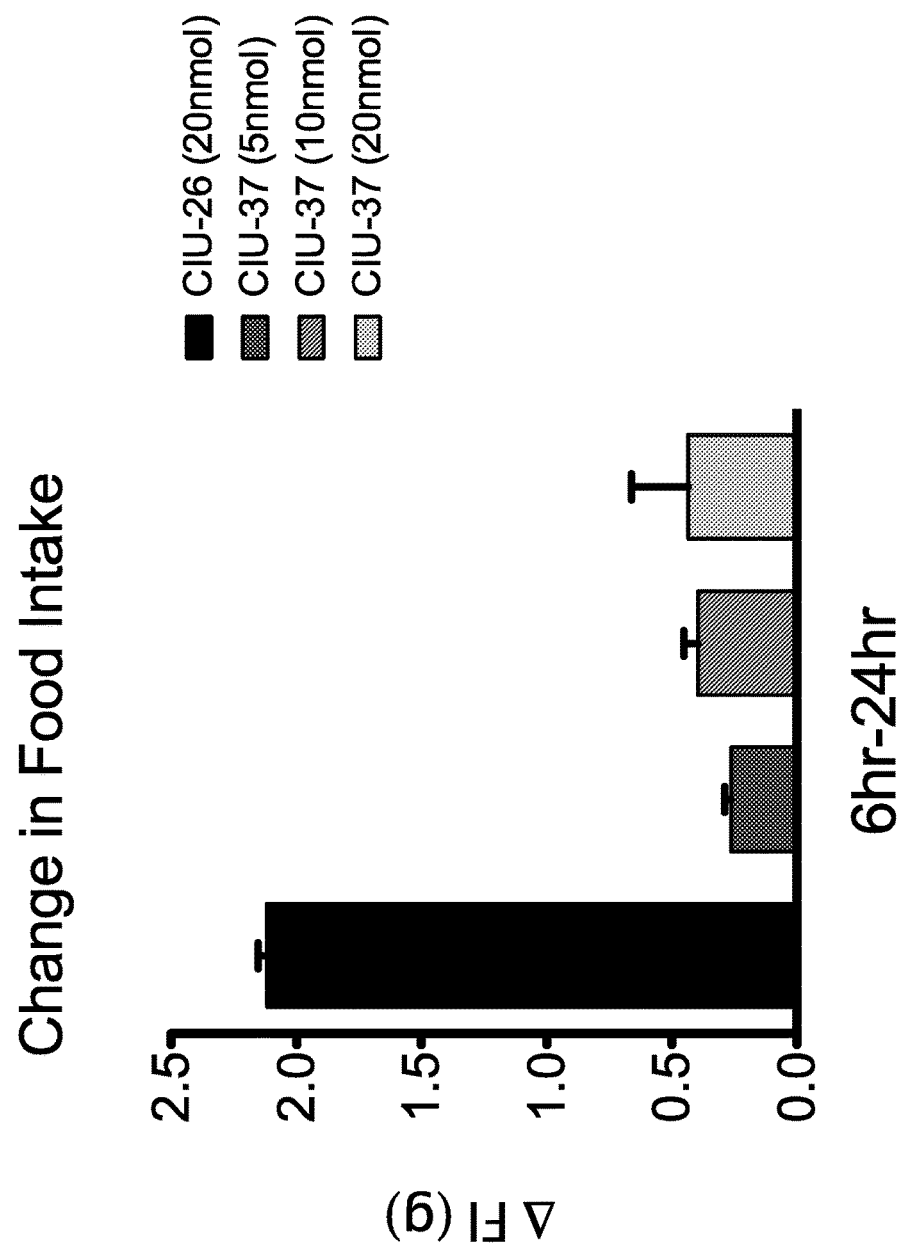
Figure 17A:
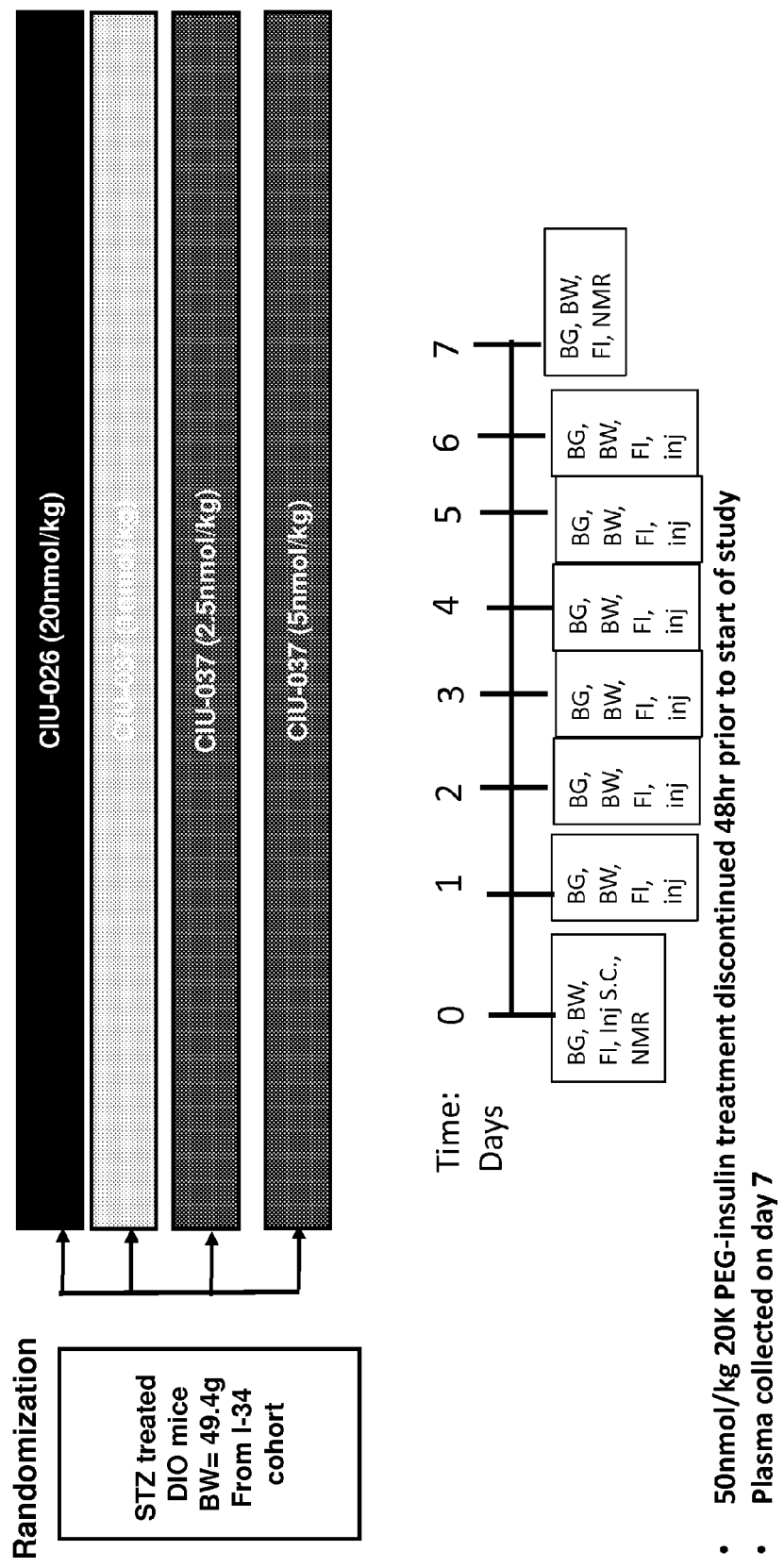
FIGS. 17A-17E provide the results of an experiment conducted on diabetic mice administered three different doses (1, 2.5 or 5 nmol/kg) of a pegylated GLP-1/insulin conjugate (CIU-037). CIU-037 is pegylated with a 20K PEG at position 40 of the GLP-1 moiety. Animals were also administered 20 nmol/kg of a pegylated native insulin (20 K PEG linked to the B29 side chain).
Figure 17B:
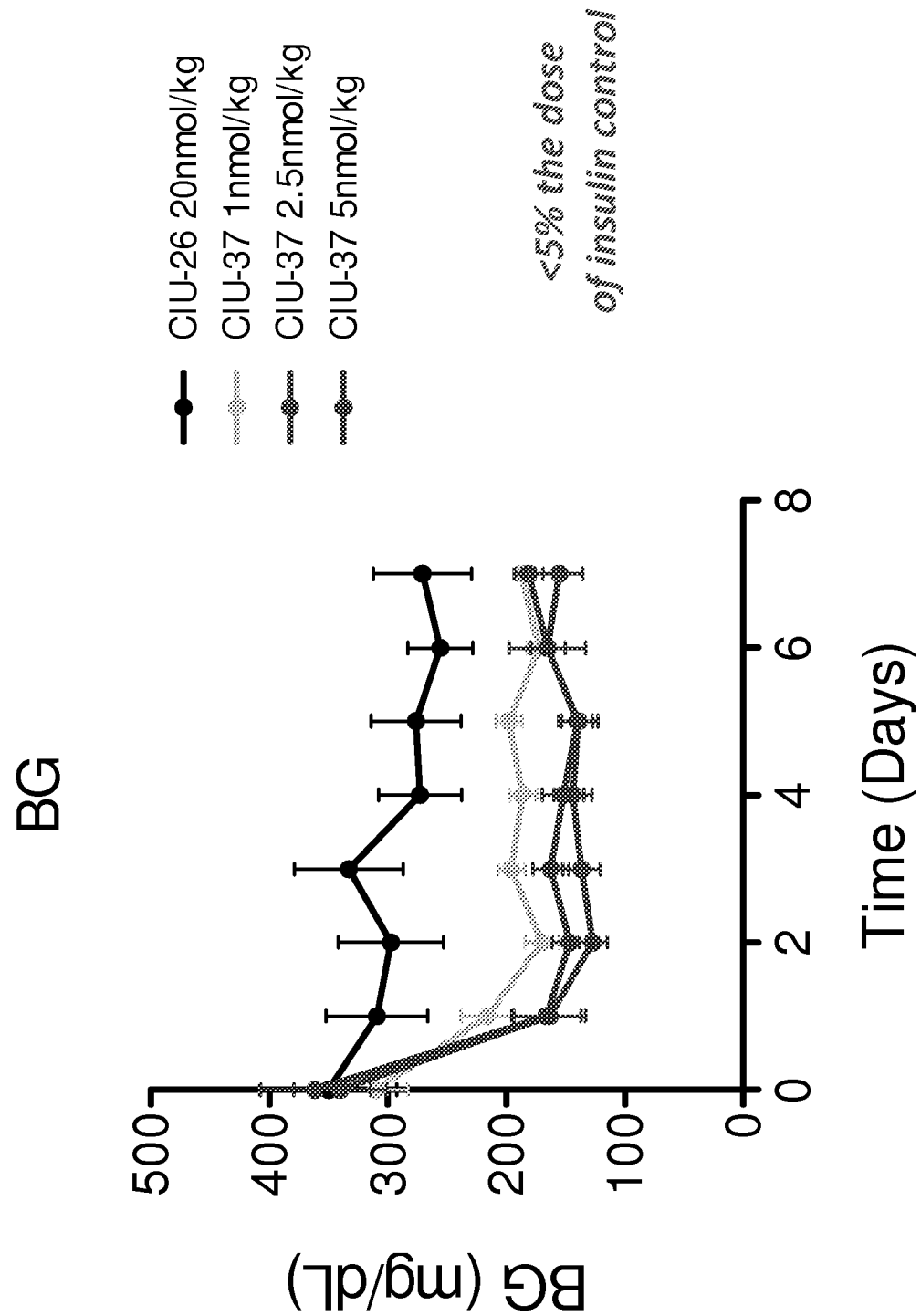
Figure 17C:
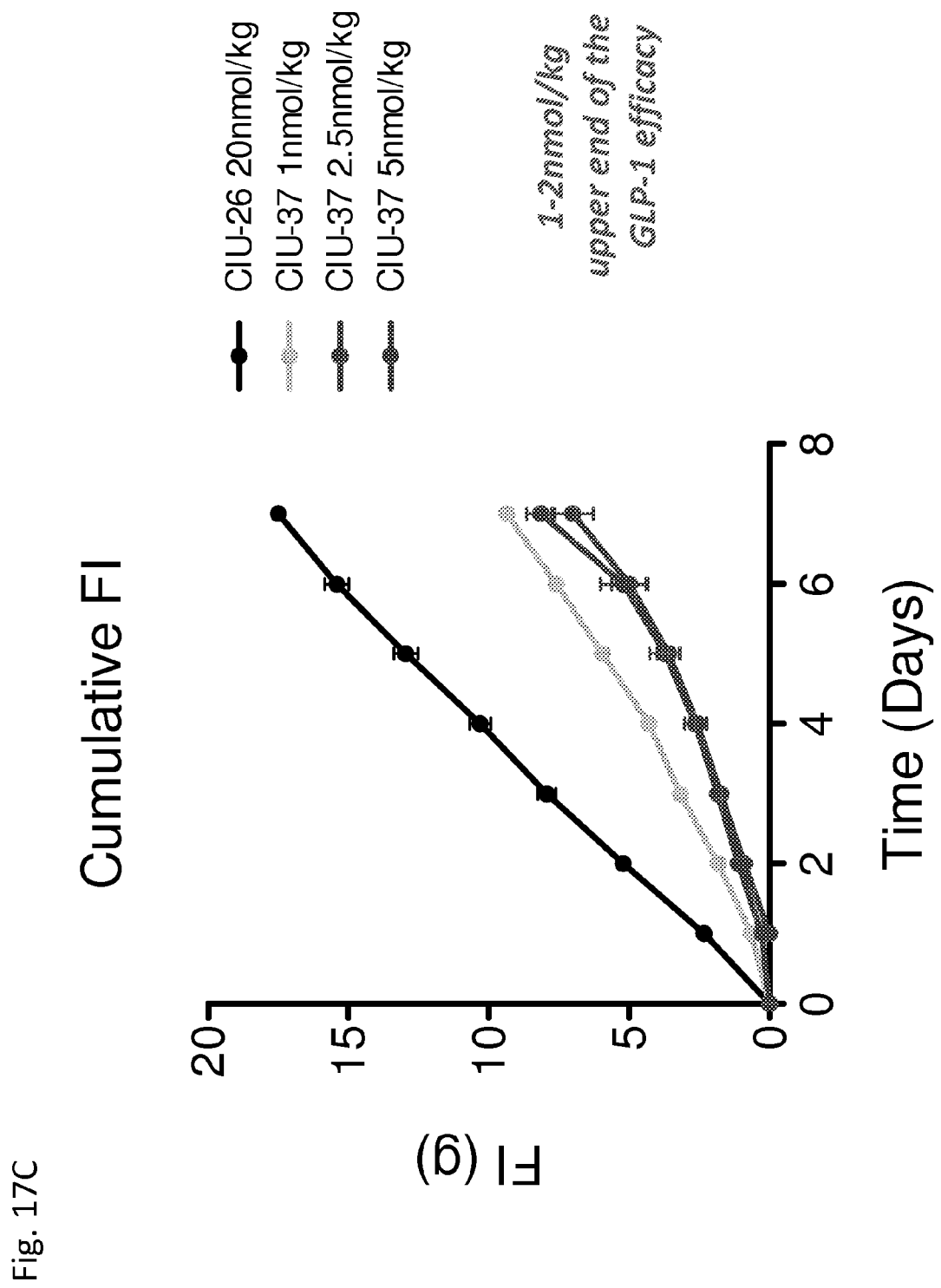
Figure 17D:
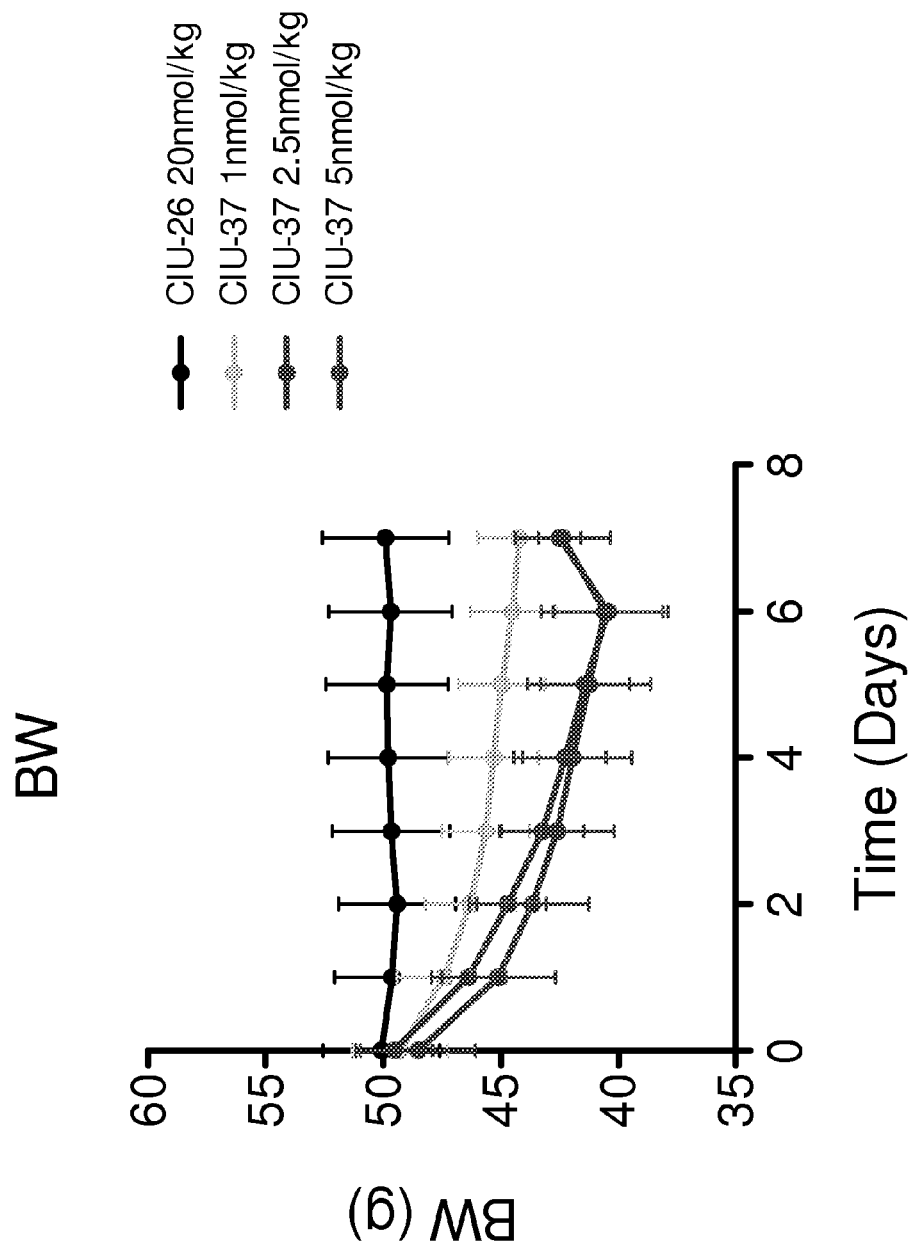
Figure 17E:
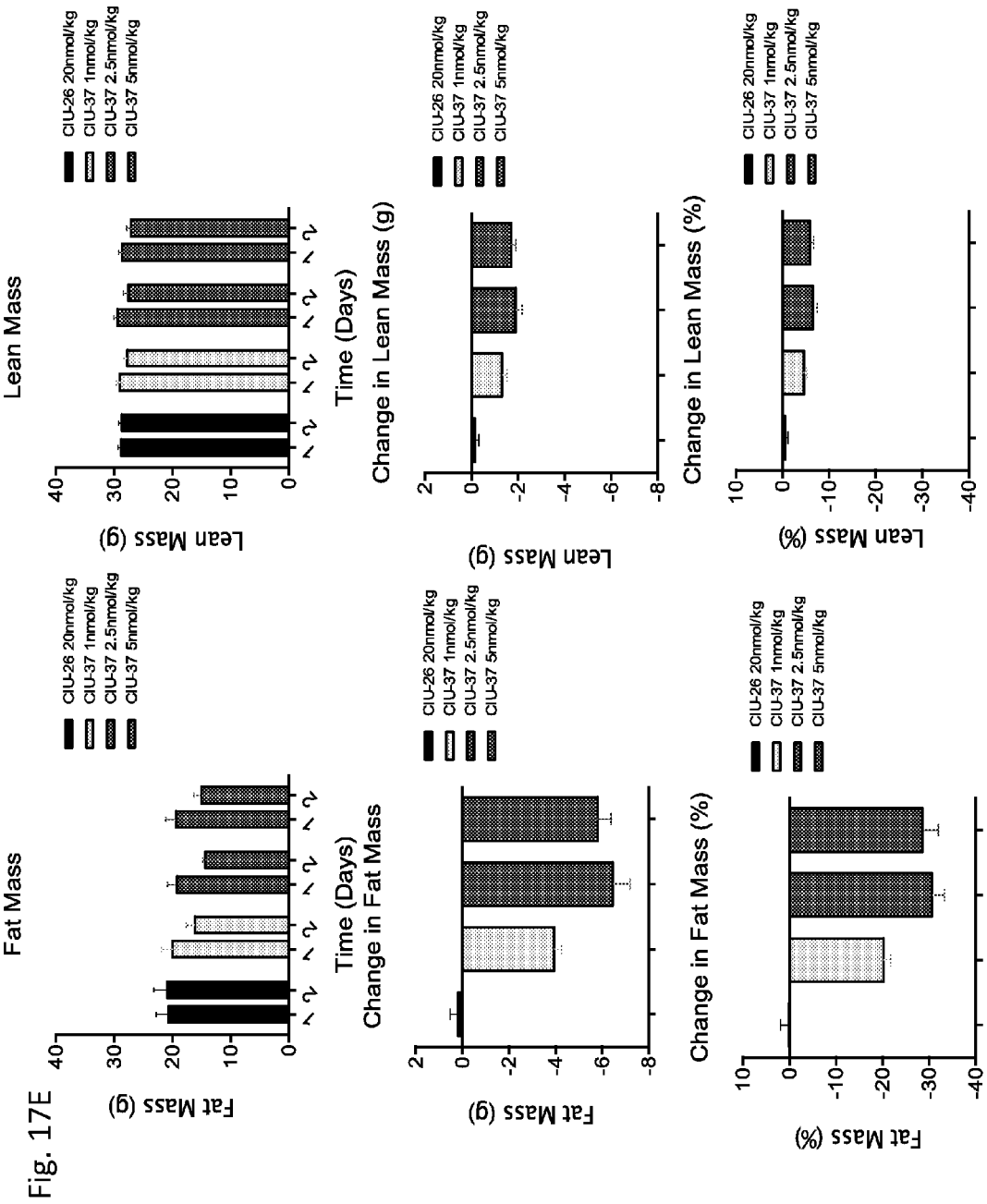
Figure 18B:
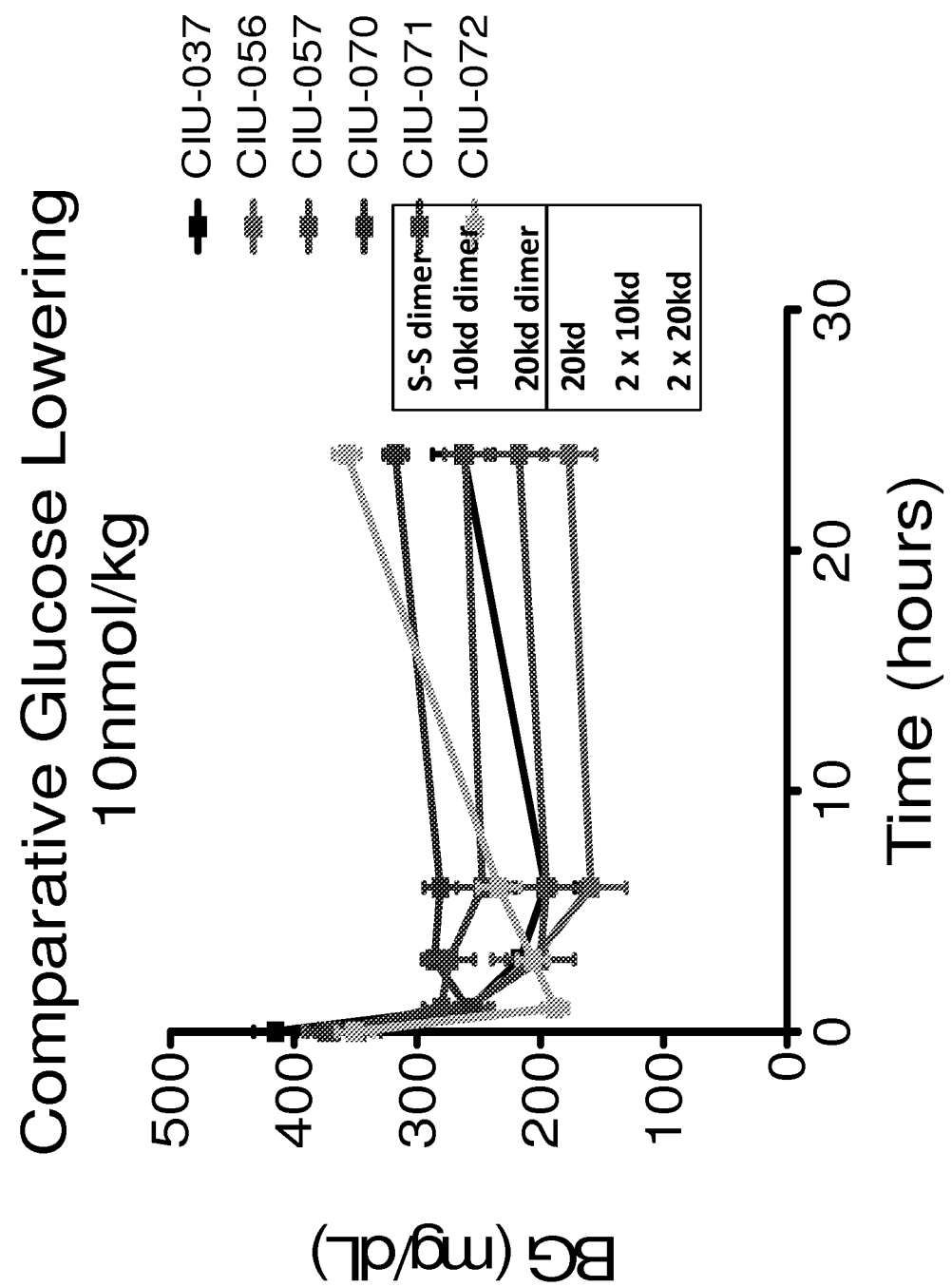
Figure 18B:
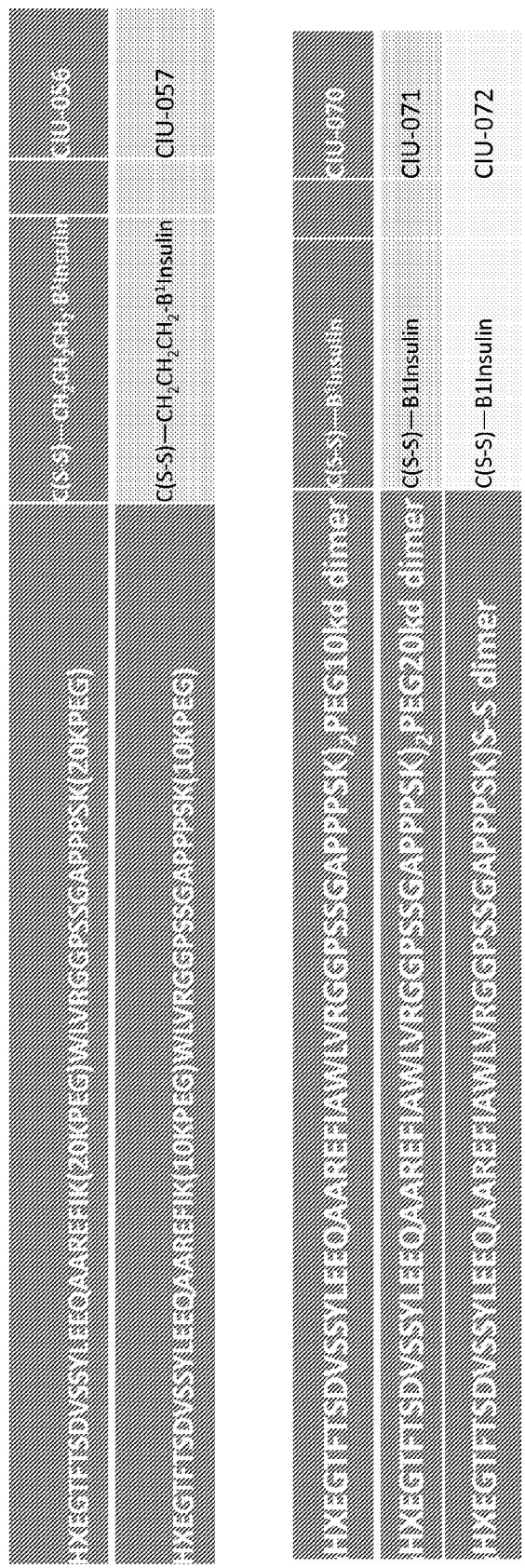
Figure 18C:
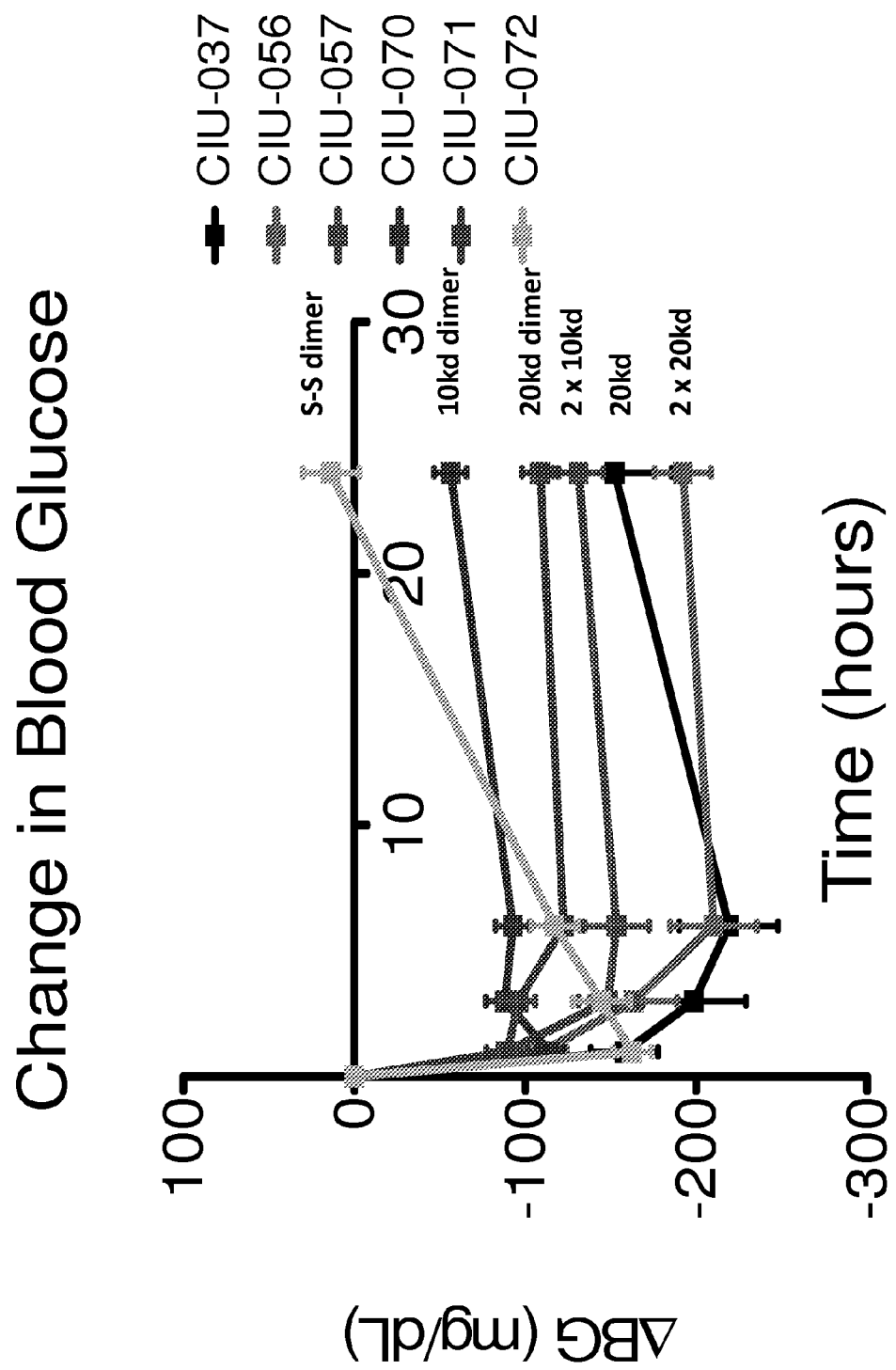
Figure 19A:
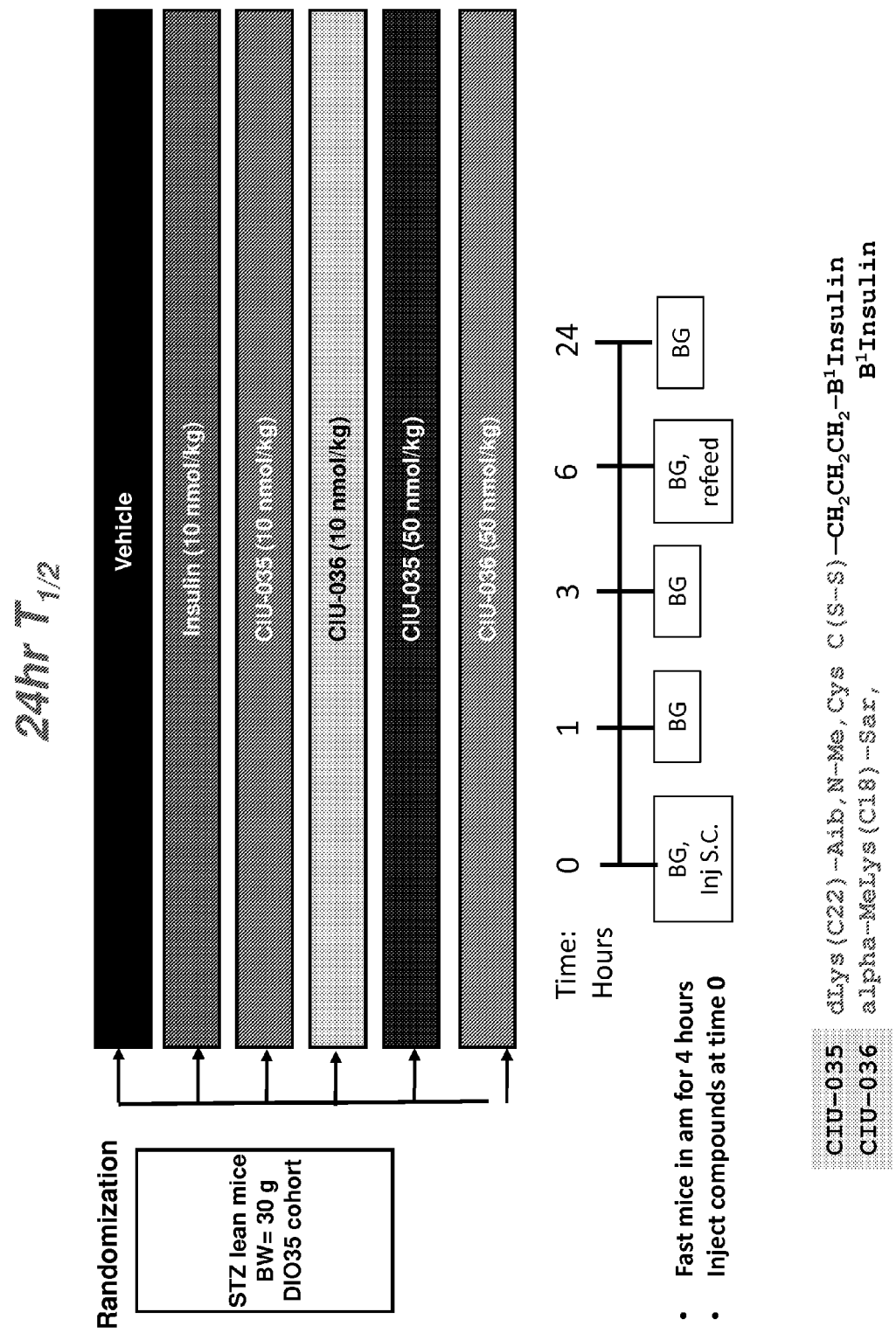
FIGS. 19A-19C provide the results of an experiment conducted on diabetic mice administered two different prodrug forms of an insulin prodrug (CIU-035 and CIU-036) wherein a self-cleaving dipeptide element (Aib, N-Me-dLys for CIU-035 and Sar,alpha-MeLys for CIU-036) is linked to the N-terminus of CIU-035/CIU-036. For CIU-035, the dipeptide element is linked via a disulfide linker of formula II to the N-terminus of B1 of insulin. For CIU-036, the dipeptide element is linked via direct amide bond to the B1 amine nitrogen. The dipeptide element has an acyl group of C22 or C18 linked to the lysine side chain of the dipeptide element.
Figure 19B:
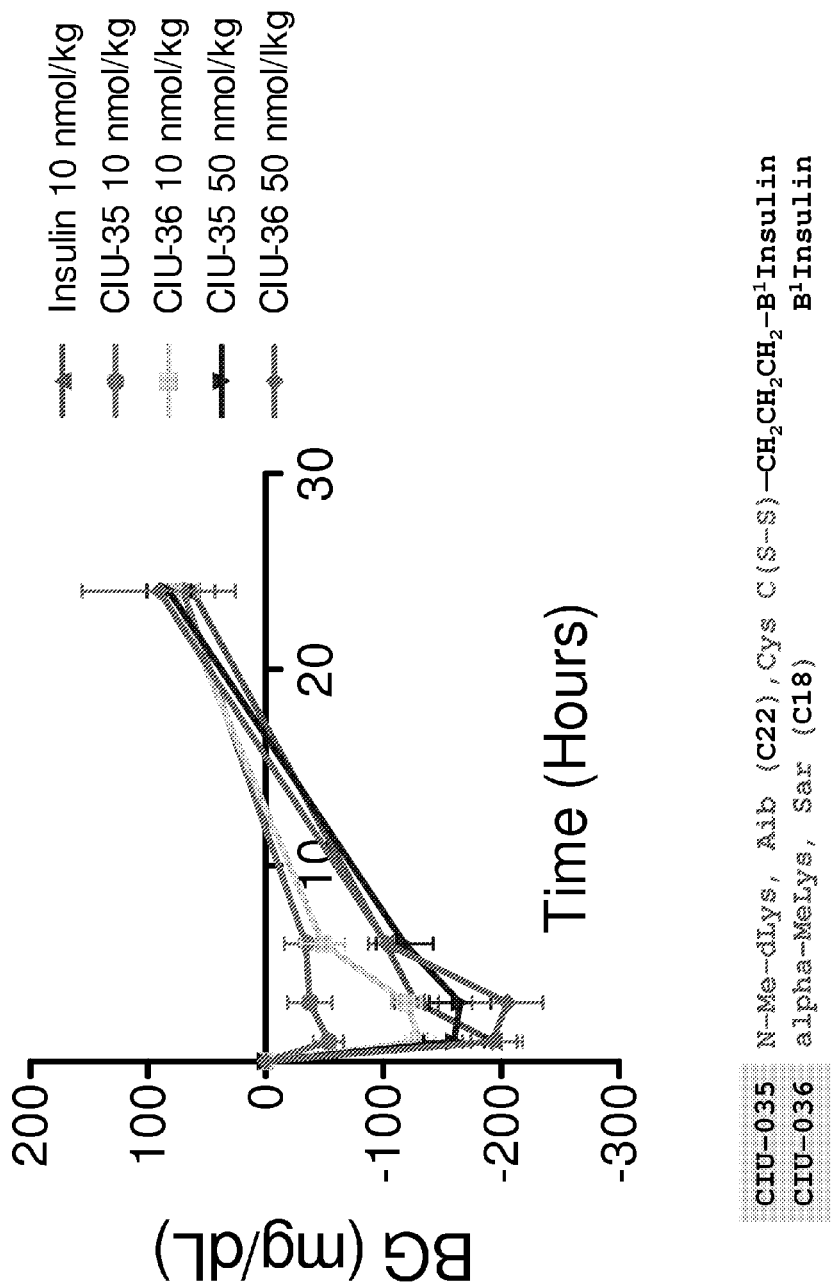
Figure 19C:
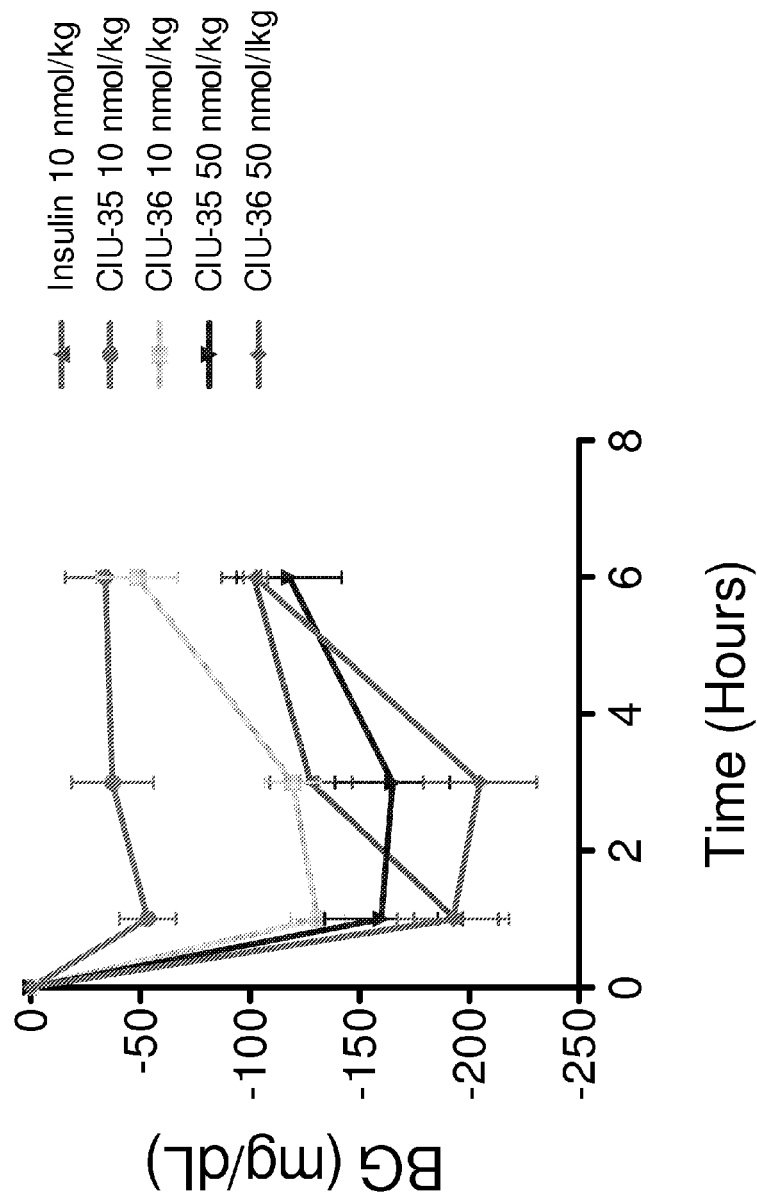
Figure 20:
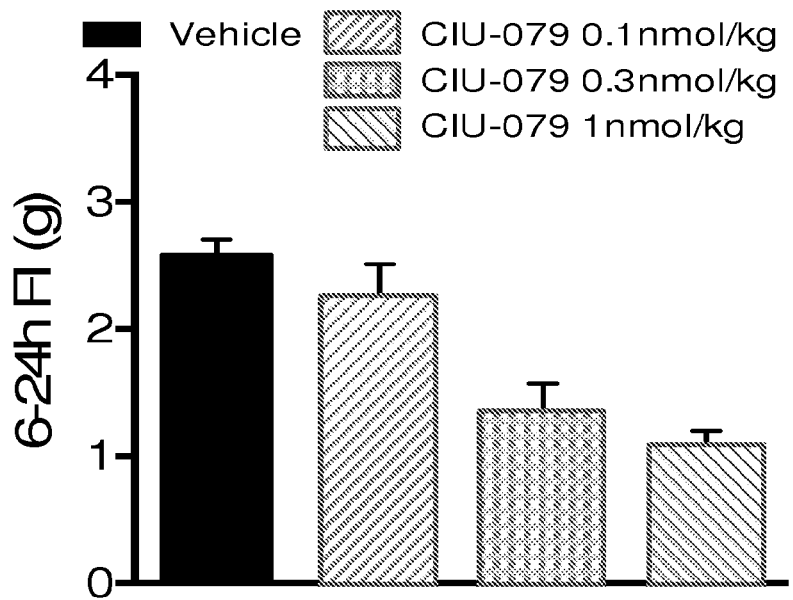
FIG. 20 is a bar graph showing the dose titration of incretin insulin conjugate CIU-079 (native insulin, GIP-GLP Co-agonist increlin; see Table 4) on food intake. CIU-079 exhibits activity at each of the GIP, GLP-1 and insulin receptors.
Figure 21:
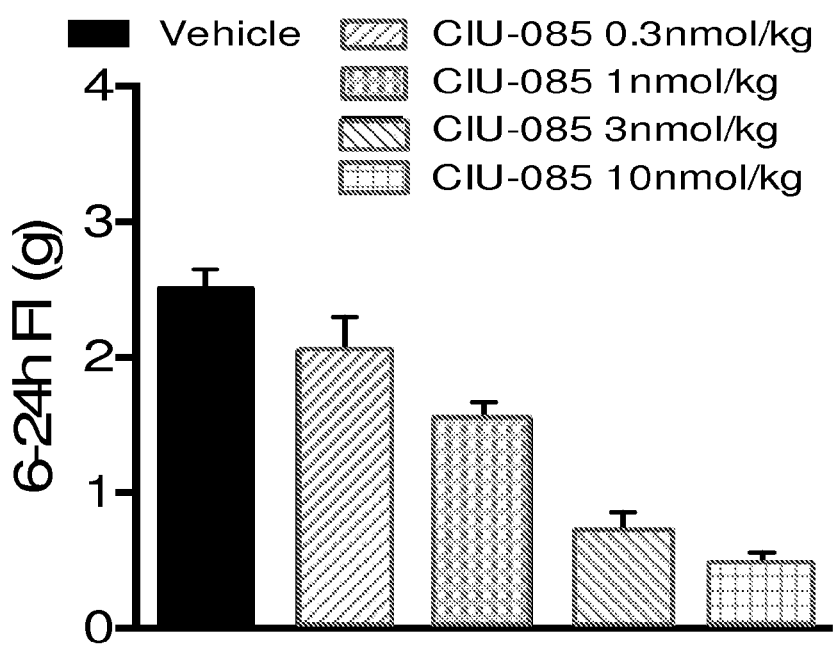
FIG. 21 is a bar graph showing the dose titration of incretin-insulin conjugate CIU-085 (des-Di, GIP-GLP Co-agonist increlin; see Table 4) on food intake. The des-Di insulin analog is an insulin single chain formed by fusing a modified B chain terminus (B27 and B29 deleted) directly to the N-terminus of the A chain. This insulin analog is inactive at the insulin receptor. CIU-085 exhibits activity at each of the GIP and GLP-1 receptors, but not at the insulin receptor.
Figure 22:
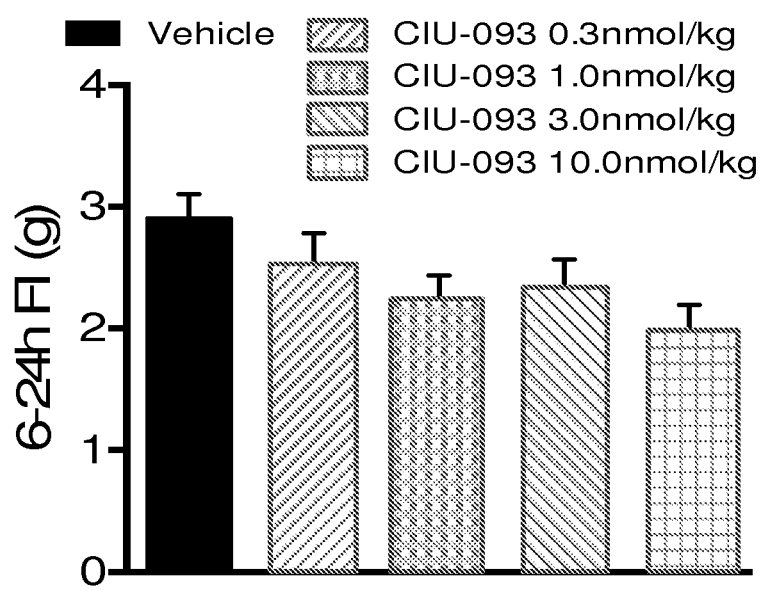
FIG. 22 is a bar graph showing the dose titration of incretin insulin conjugate CIU-093 (native insulin, des-Tyr1, GIP-GLP Co-agonist increlin; see Table 4) on food intake. The des-Tyr1glucagon analog is inactive at the GLP-1 and GIP receptors. CIU-085 exhibits activity only at the insulin receptor and not at either of the GIP and GLP-1 receptors. This conjugate has no incretin activity and therefore does not suppress food intake.
Figure 23:
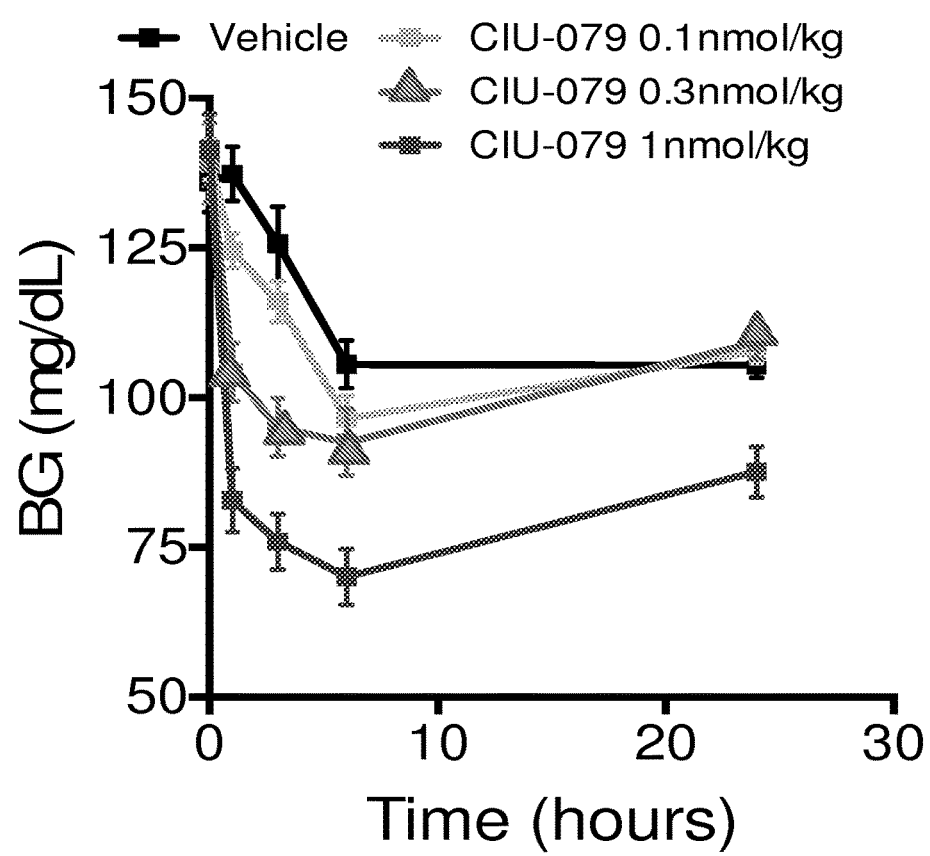
FIG. 23 is a graph showing the dose titration of incretin insulin conjugate CIU-079 (native insulin, GIP-GLP Co-agonist increlin; see Table 4) on blood glucose.
Figure 24:
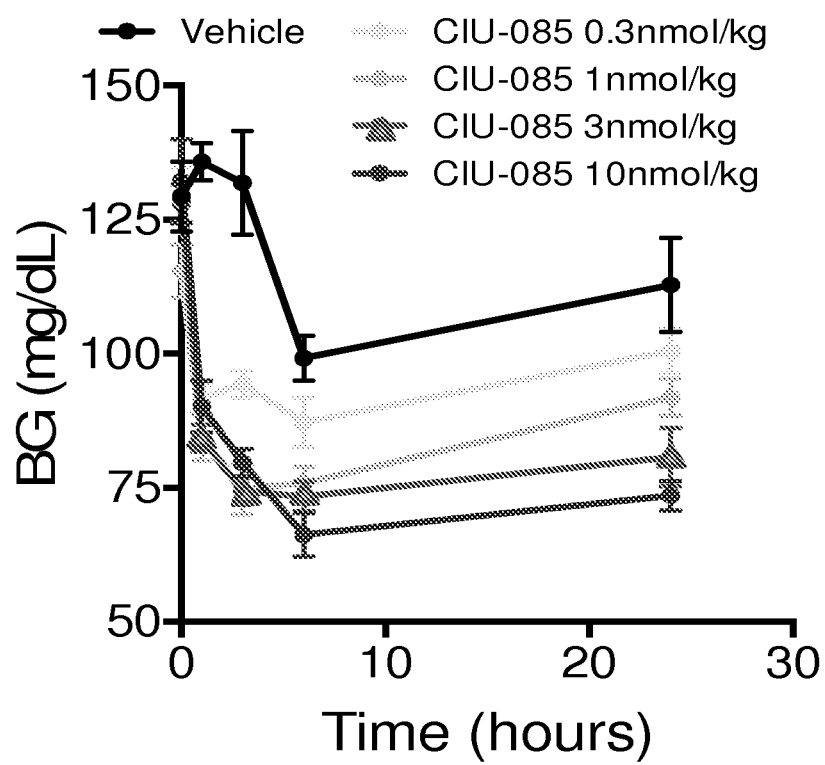
FIG. 24 is a graph showing the dose titration of incretin insulin conjugate CIU-085 (des-Di, GIP-GLP Co-agonist increlin; see Table 4) on blood glucose.
Figure 25:
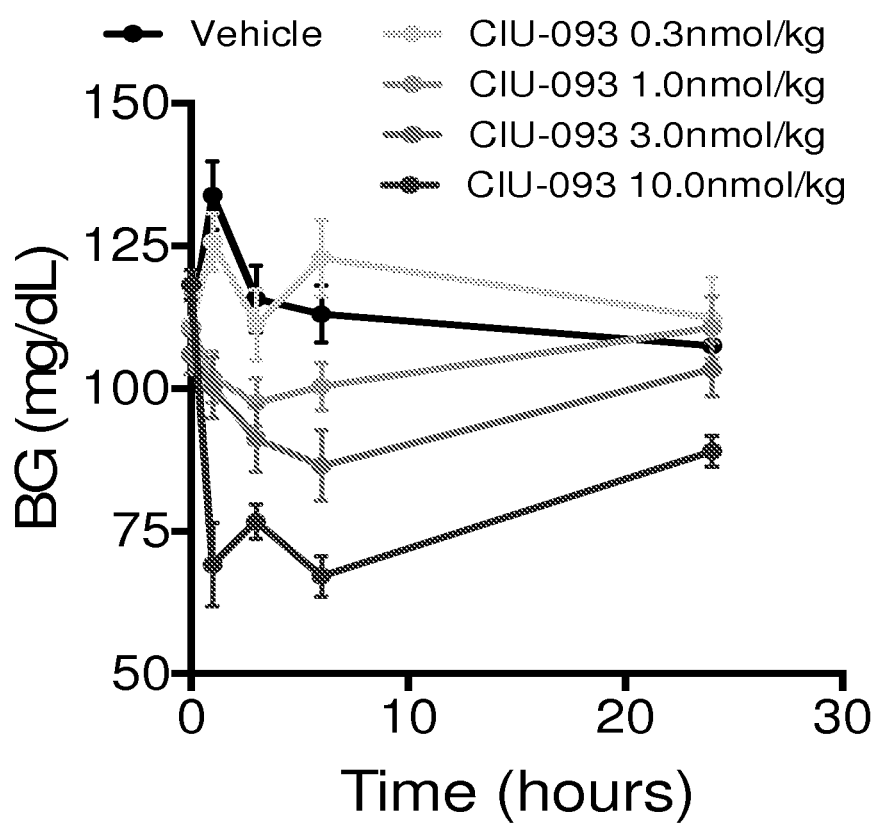
FIG. 25 is a graph showing the dose titration of incretin insulin conjugate CIU-093 (native insulin, des-Tyr1, GIP-GLP Co-agonist increlin; see Table 4) on blood glucose. Without the incretin activity a much higher dosage is required to get the same glucose lowering as seen with CIU-079 and CIU-085.
Figure 26:
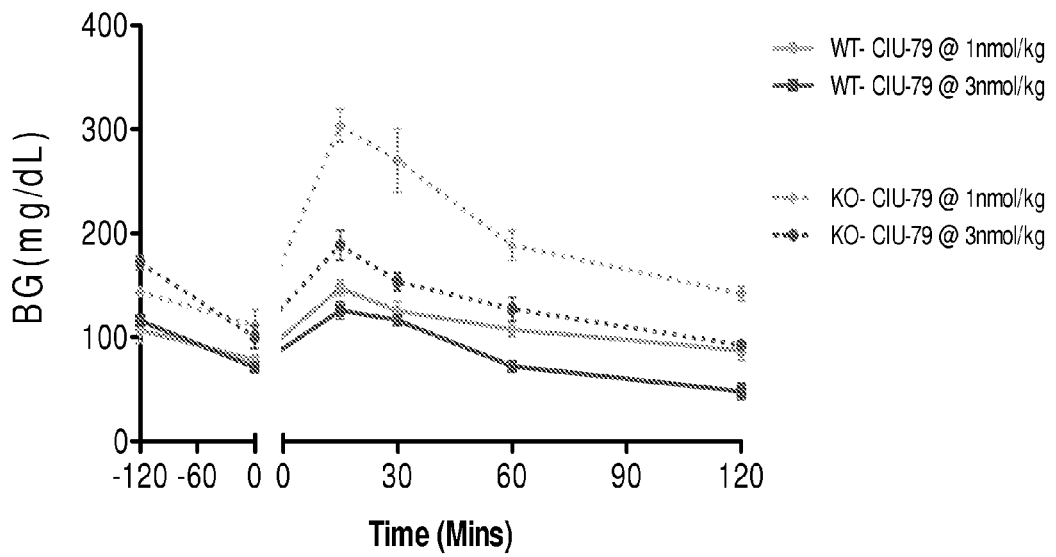
FIG. 26 is a graph of a glucose tolerance test conducted on wild type mice (solid lines) and on GPL-1 receptor knock out mice (dashed lines). Mice were administered either a 1 nmol/kg or 3 nmol/kg dose of incretin insulin conjugate CIU-079 two hours prior to a glucose challenge. The data demonstrates that these compounds have both incretin activities (GLP-1 and GIP activity) as they are fully functional in wild type and lose activity in GLP-1 knock out mice, but that lost activity can be overcome by increased dosage.
Figure 27:
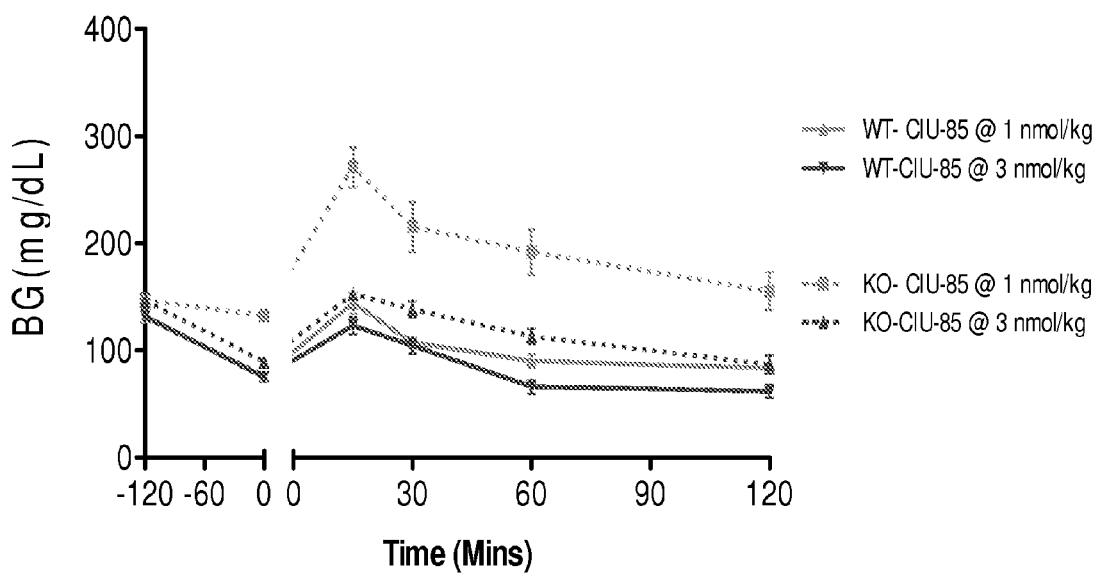
FIG. 27 is a graph of a glucose tolerance test conducted on wild type mice (solid lines) and on GPL-1 receptor knock out mice (dashed lines). Mice were administered either a 1 nmol/kg or 3 nmol/kg dose of incretin insulin conjugate CIU-085 two hours prior to a glucose challenge. The data demonstrates that these compounds have both incretin activities GLP-1 and GIP activity as they are fully functional in wild type and lose activity in GLP-1 knock out mice but that can be overcome by increased dosage.
Figure 28:
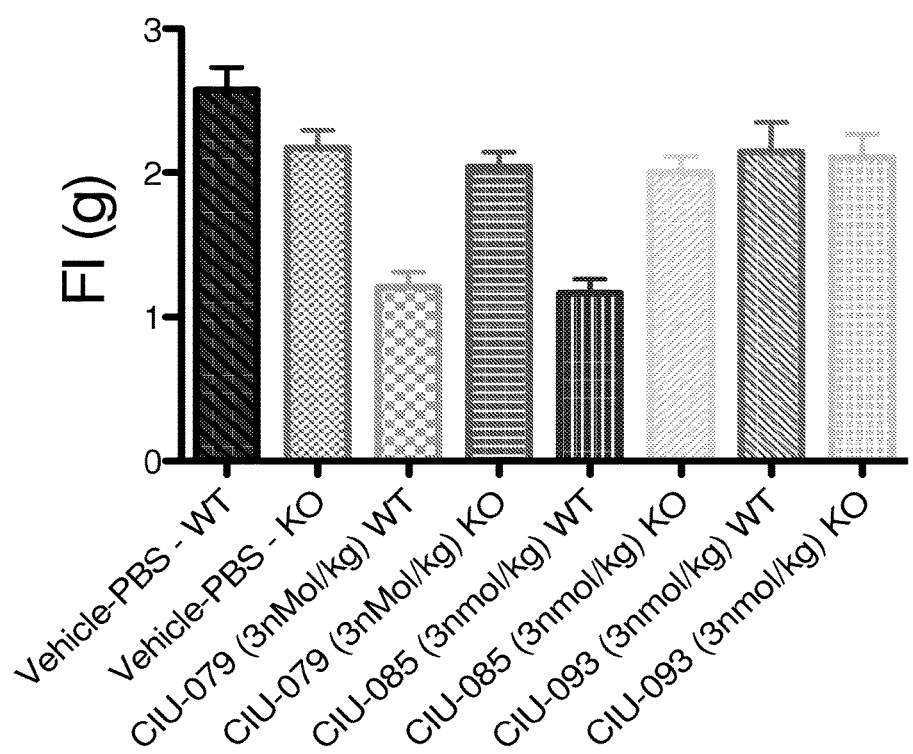
FIG. 28 is a bar graph demonstrating the effect of various incretin insulin conjugates (CIU-079, CIU-085 and CIU-093) on food intake (FI measured in grams) when administered at a dosage of 3 nmol/kg to either wild type mice or GPL-1 receptor knock out mice. Food intake is regulated by GLP-1 so in the GLP-1 knock out mice no reduction in food intake is seen for any of the administered compounds, however CIU-079 and CIU-085, but not CIU-093 suppresses food intake in wild type mice.
Figure 29:
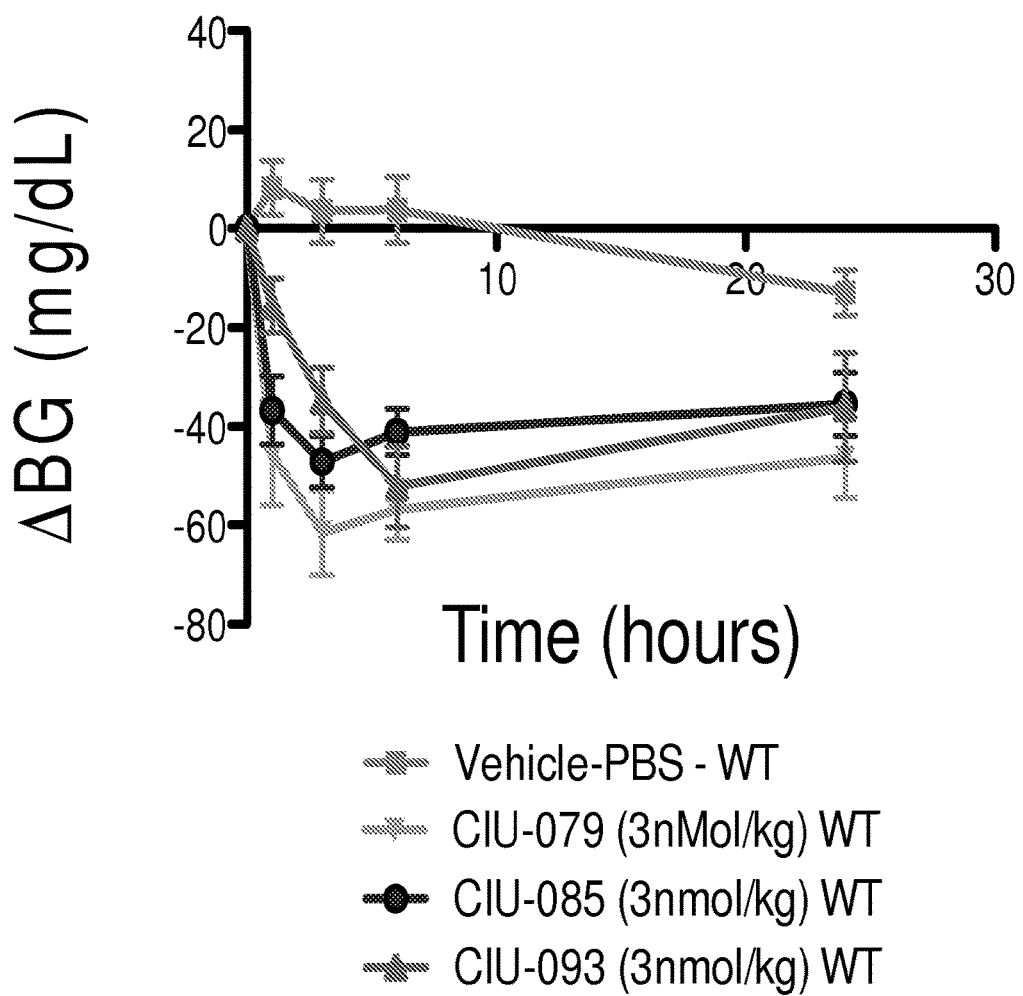
FIG. 29 is a graph demonstrating the effect of various incretin-insulin conjugates (CIU-079, CIU-085 and CIU-093) on blood glucose when administered at a dosage of 3 nmol/kg to wild type mice.
Figure 30:
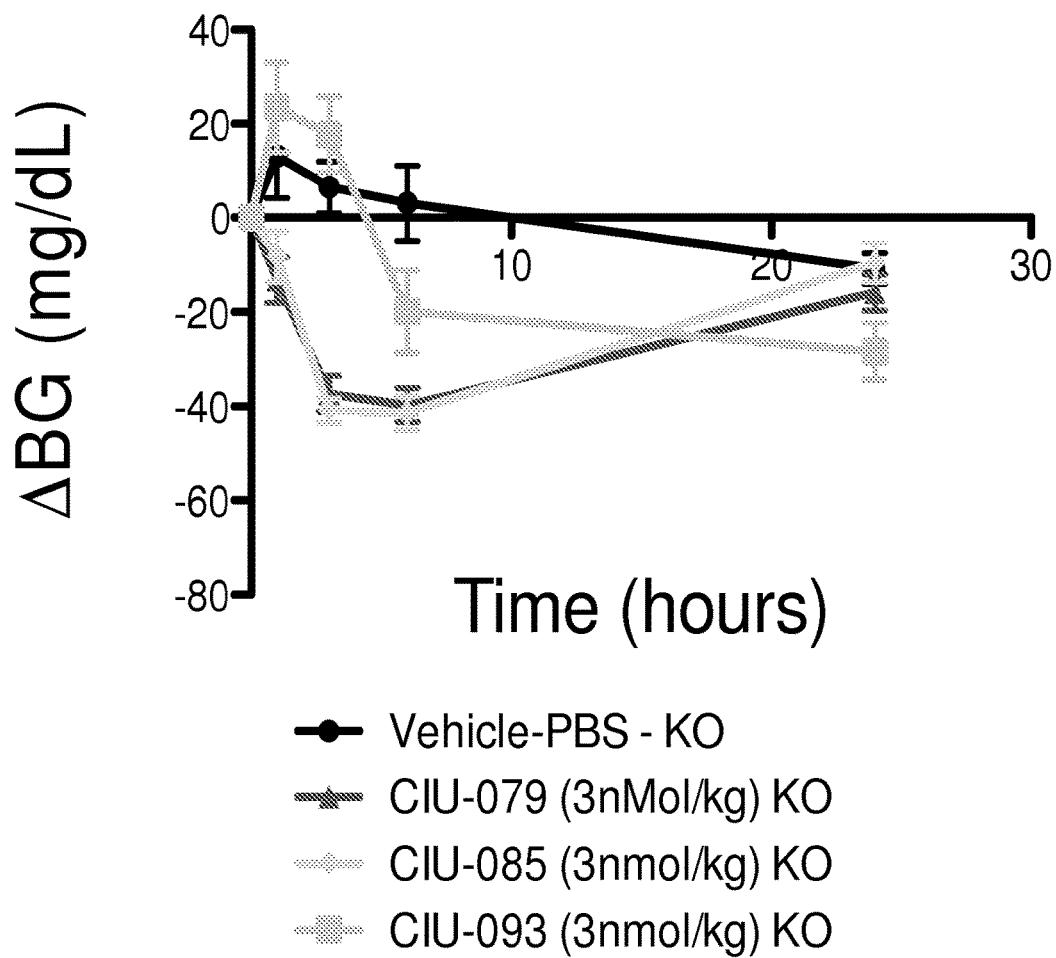
FIG. 30 is a graph demonstrating the effect of various incretin-insulin conjugates (CIU-079, CIU-085 and CIU-093) on blood glucose when administered at a dosage of 3 nmol/kg to GPL-1 receptor knock out mice.
Figure 31:
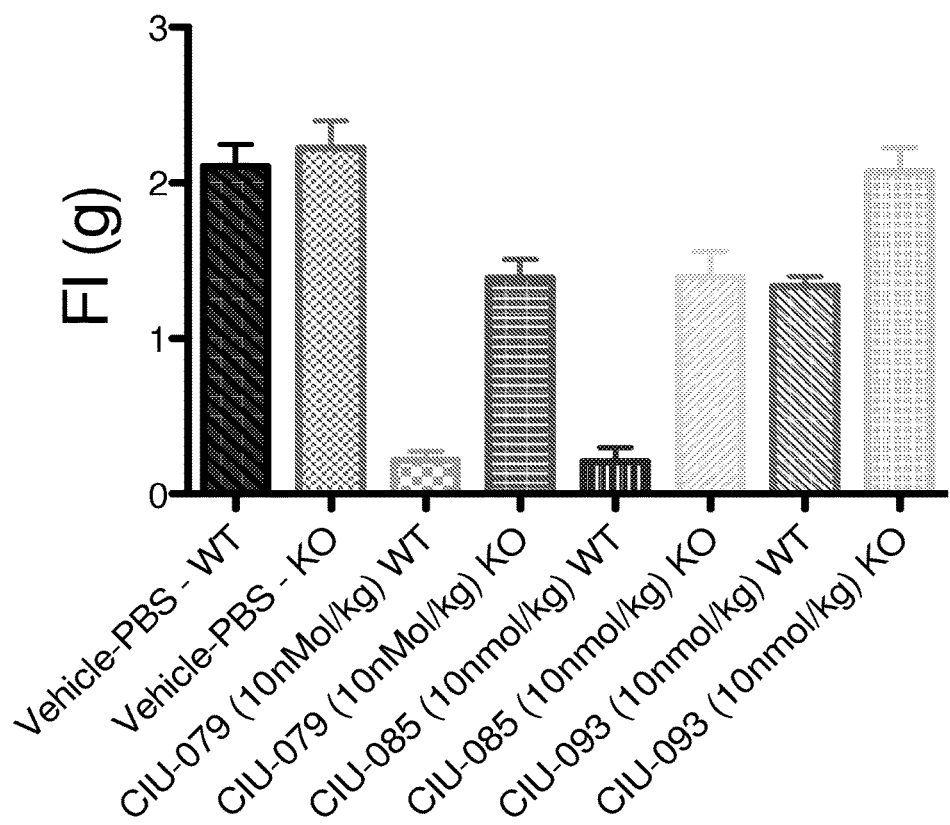
FIG. 31 is a bar graph demonstrating the effect of various incretin insulin conjugates (CIU-079, CIU-085 and CIU-093) on food intake (FI measured in grams) when administered at a dosage of 10 nmol/kg to either wild type mice or GPL-1 receptor knock out mice.
Figure 32:
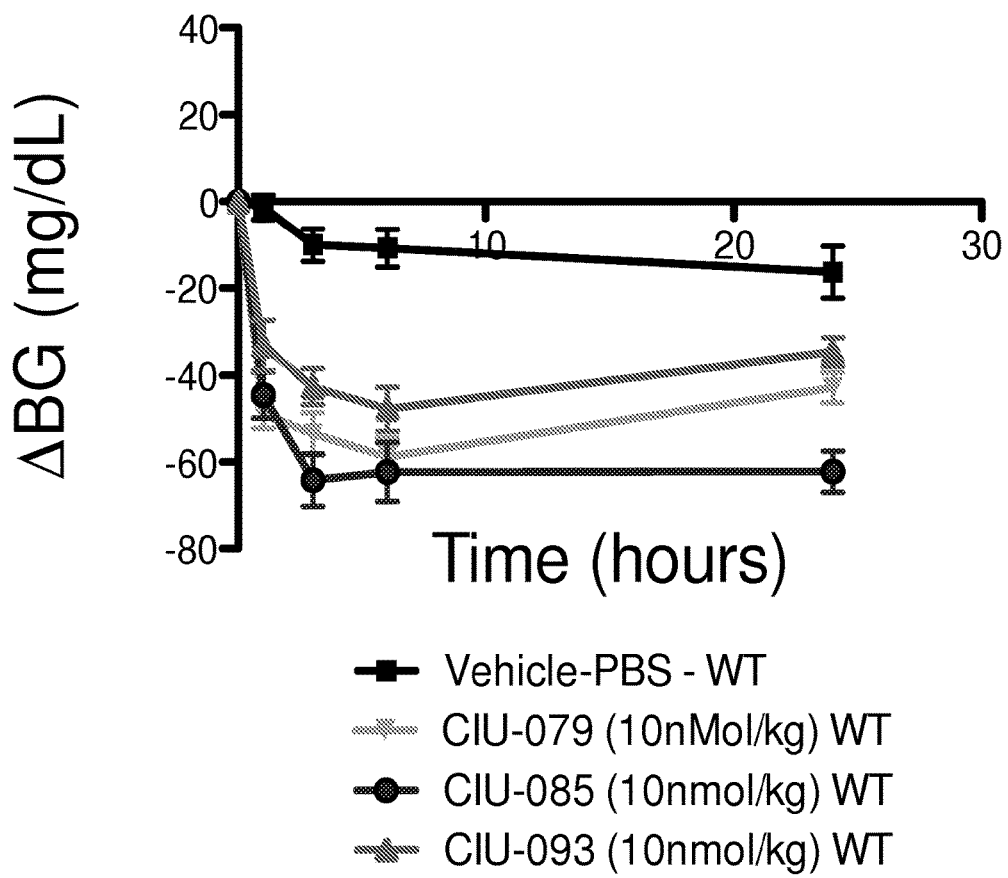
FIG. 32 is a graph demonstrating the effect of various incretin-insulin conjugates (CIU-079, CIU-085 and CIU-093) on blood glucose when administered at a dosage of 10 nmol/kg to wild type mice.
Figure 33:
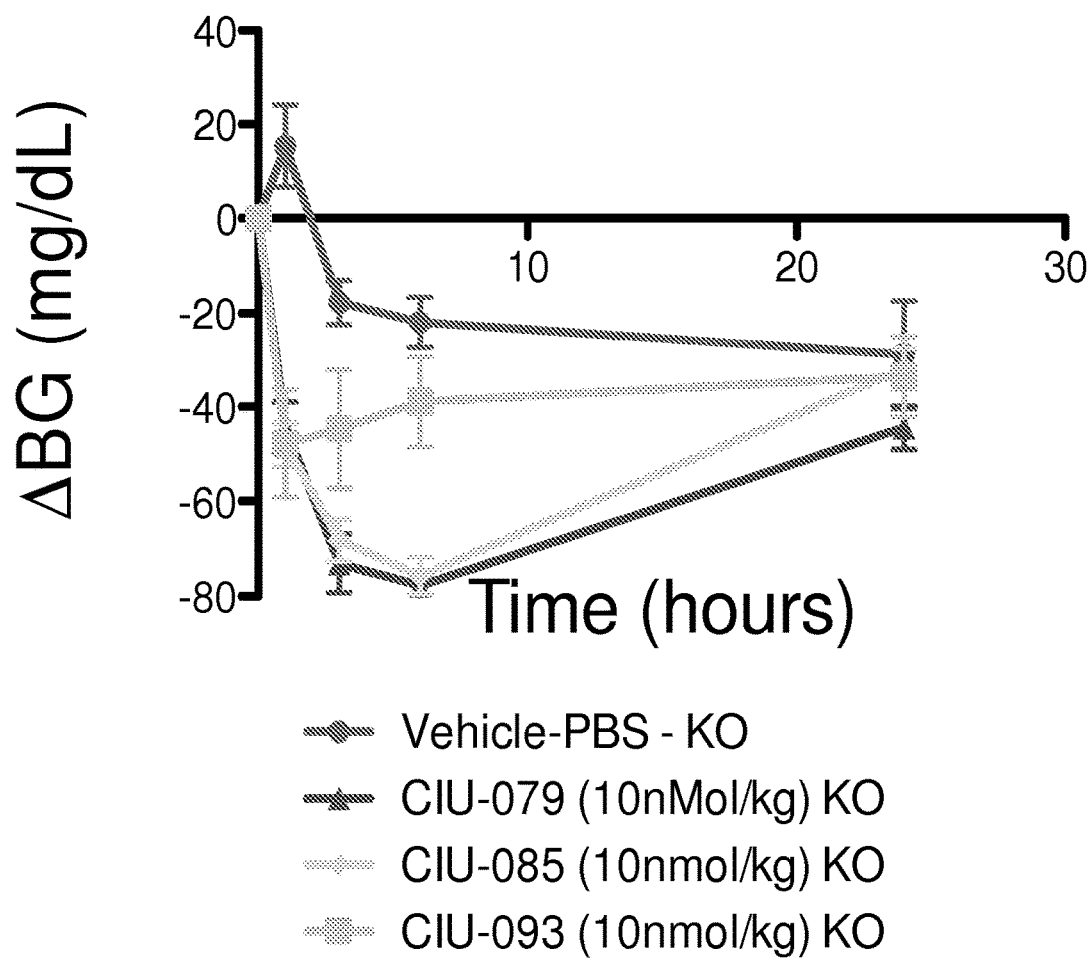
FIG. 33 is a graph demonstrating the effect of various incretin-insulin conjugates (CIU-079, CIU-085 and CIU-093) on blood glucose when administered at a dosage of 10 nmol/kg to GPL-1 receptor knock out mice.
Figure 34:
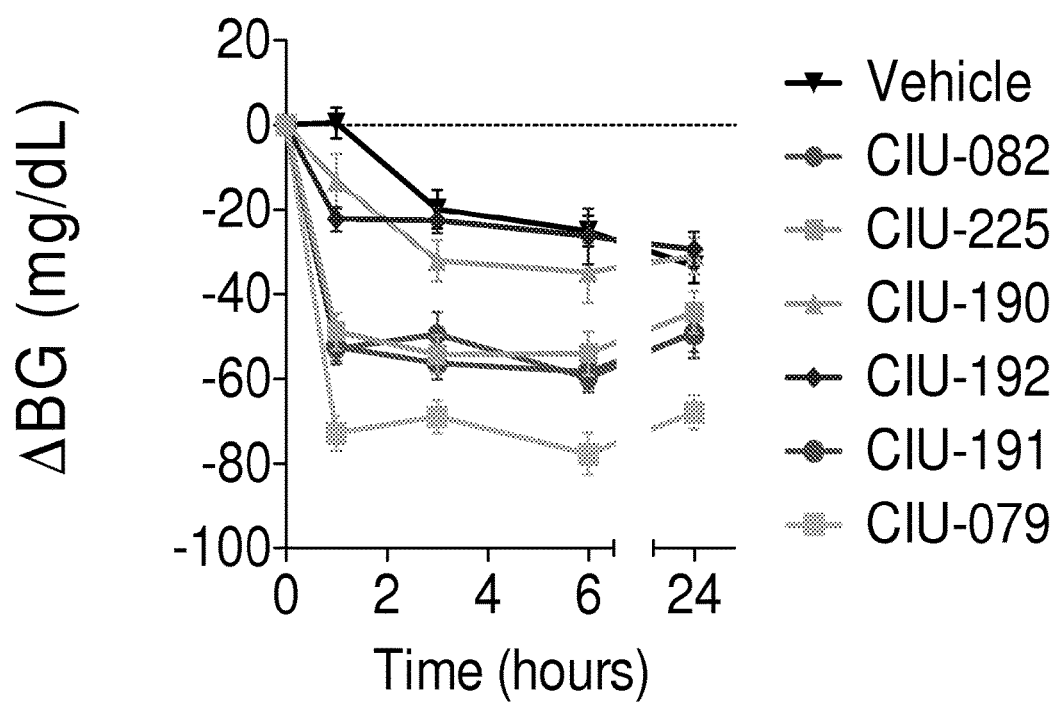
FIG. 34 is a graph demonstrating the effect of various incretin-insulin conjugates (CIU-079, CIU-082, CIU 190, CIU 191, CIU 192 and CIU-225) on blood glucose when administered at a dosage of 3 nmol/kg to diet induced obesity (DIO) mice.

The regioselective modification of the B-chain N-terminus (Chem. Biol. Drug. Des. 2007.69.132) with the linker is conducted under acidic conditions in a sodium acetate buffer at pH 4.0, the concentration of insulin is 1 mg/ml, although it can be carried out at considerably higher concentration (Scheme 2; FIG. 4B). The reductive amination uses a 1.5-2.0 fold excess of the aldehyde and a 30 fold molar excess of sodium cyanoborohydride. The reaction is stirred overnight and is monitored by HPLC. It is stopped by addition of glycine to consume excess aldehyde. The product is recovered by preparative HPLC, with the desired isomer yield of 60%.

The detritillation shown in Scheme 3 (FIG. 4C) is accomplished by dissolving the product from Scheme 2 in neat TFA containing 2% triisopropylsilane, 2% $H_2O$ at a 5-10 mg/ml concentration of the insulin derivative. The detritylated material is recovered by ether precipitation and centrifugation in >95% yield.

The conjugation with 2-thiopyridyl activated incretin (GLP-1, GIP or co-agonist) is accomplished by combining the two solids and co-dissolving in 6M guanidine, pH 6.0 buffer at a total peptide concentration of 20 mg/ml. The reaction is complete in 30-60 minutes and the product is recovered by preparative HPLC (Scheme 4; FIG. 4D).

Synthetic Procedures

Synthesis of Trt-S—$(CH_2)_2$CHO (S-trityl-3-thiopropionaldehyde)[1]

Triphenylmethanethiol (Trt-SH) 2.0 mmoles (553 mg) was dissolved in 4.0 ml of dry methylene chloride, 3.0 mmoles (418 µL) of triethylamine was added along with acrolein, 2.0 mmoles (134 µl) and the reaction was stirred at room temperature for 2 hours. The reaction was monitored by thin-layer chromatography (silica gel, n-hexane/methylene chloride 3:1) which indicated that the reaction was complete at this time. The solvent was removed under reduced pressure and the residue triturated with n-hexane.

The crude solid was recrystallized from a mixture of ethyl acetate/hexane to obtain 530 mg, 80% yield.

Synthesis HS—(CH$_2$)$_3$-PheB1-Human Insulin$^2$ 41.3 µmoles (240 mg) of human insulin (Sigma) was dissolved in a buffer containing 20 mM NaOAc, 200 mM NaCl buffer adjusted to pH 4.0. 100 µmoles (33 mg) of S-trityl-3-thiopropionaldehyde in 1.0 ml of NMP was added to the solution along with 1.2 micromoles (75 mg) of NaCNBH3. The reaction was stirred at room temperature. An additional 40 µmoles of the aldehyde in 0.4 ml NMP was added after 6.0 hours and the reaction was allowed to proceed overnight. LC/MS analysis indicated that only a small amount (<5%) of unmodified insulin remained. The reaction mixture was centrifuged, the pellet dissolved in acetonitrile/H2O and adsorbed onto a Luna C8(2) 250 mm×21.2 mm preparative HPLC column and eluted with a linear 10-55% gradient over 90 mins. Buffer A: 10% ACN/0.1% TFA, Buffer B: ACN/0.1% TFA, flow rate: 15 ml/min, monitoring at 220 nm. Selected fractions were pooled and lyophilized to yield 144 mg, ~60% Trt-S—(CH$_2$)$_3$-PheB1-human insulin. The trityl group was removed by treatment of 100 mg the protected derivative with 20 ml TFA containing 2% triisopropylsilane, 2% water for 20 minutes, followed by precipitation with diethyl ether and lyophilization to afford HS—(CH$_2$)$_3$-PheB1-human insulin in 95% yield.

Synthesis of GLP-1/GIP/GLCG Peptide (Incretin Component)

Incretin peptides were synthesized using standard Fmoc/tBu-methodology at 0.1 mmol scale on an Applied Biosystems 433A synthesizer starting with Rink ChemMatrix (source) resin utilizing a ten-fold excess of amino acid and DIC/6-Cl-HOBt activation. The following side chain protecting group scheme was utilized: Arg(Pbf), Asp(OtBu), Asn(Trt), Cys(Trt), Gln(Trt), Glu(OtBu), His(Trt), Lys (Boc), Ser(tBu), Thr(tBut), Tyr(tBu). The N-terminal His coupling was achieved by treating the peptidyl resin with a tenfold excess of FmocHis(Trt)-OH, DEPBT and twentyfold excess of DIEA in 5.0 ml DMF for 90 minutes. The N-terminal Fmoc group was removed by two 20 minute treatments of 20% piperidine in DMF. Cleavage from the resin and simultaneous conversion to the activated 2-dithiopyridyl activated form was accomplished by suspending the resin in 5 ml TFA containing 100 ul triisopropylsilane, 100 ul water and 20 equivalents of 2-Aldrithiol reagent for 2.0 hrs. Cleaved peptides were precipitated and washed with diethyl ether and dissolved in 20% aqueous acetonitrile containing 1% acetic acid and purified by preparative chromatography. Peptide molecular weights were confirmed by electrospray ionization or MALDI-TOF mass spectrometry and either directly lyophilized or purified by reverse phase chromatography.

Ligation of GLP-1/GIP/GLCG peptide and HS—(CH$_2$)$_3$-PheB-Human Insulin.

3.0 µmoles (17.7 mg) of HS—(CH$_2$)$_3$-PheB I-human insulin and 3.0 µmoles (13.5 mg) of the 2-thiopyridyl incretin were placed is a small vial and dissolved in 1.5 ml of 6.0M guanidine buffer adjusted to pH 6.0. The reaction was stirred for 1 hour, diluted with 2% aqueous AcOH and purified by preparative HPLC to yield 50% of the ligated material following lyophilization. HPLC conditions: Luna C8(2) 250 mm×21.2 mm preparative HPLC column and eluted with a linear 10-55% gradient over 90 mins. Buffer A: 10% ACN/0.1% TFA, Buffer B: ACN/0.1% TFA, flow rate: 15 ml/min, monitoring at 220 nm.

EXAMPLE 13

Incretin-insulin conjugates (increlins) in accordance with the present disclosure were synthesized essentially as described in Examples 1-7 and 12, and tested in vitro for agonist activity at each of the GLP-1 receptor, GIP and insulin receptors essentially as described in Examples 8-11. The N-terminus of the B chain is derivatized to comprise an alkyl thiol group and the incretin has a cysteine amino acid added to allow for a disulfide bond to link the two peptides. The abbreviation C(S—S)—CH2CH2CH2-B1Insulin represents a native two chain human insulin that has been derivatized at the N-terminus of the B chain with an alkyl thiol group. The abbreviation C(S—S)—CH$_2$CH$_2$CH$_2$—B$^1$Desdi represents a native human insulin that has been derivatized at the N-terminus of the B chain with a an alkylthiol group and residues B28 and B30 have been deleted and B29 directly linked to the N-terminus of the A chain via an amide bond (this single chain analog is inactive at the insulin receptor, but the B29 Lys amide bond is susceptible to cleavage by trypsin or Lys C cleavage to restore the two chain structure and full insulin activity. Thus absent enzymatic activity, an increlin comprising the Desdi insulin analog will only exhibit the associated incretin activity and not activity at the insulin receptor.

The EC50s at the GLP-1 receptor (GLP-1R), the GIP receptor (GIPR) and the insulin receptor (IR-B) are provided in Table 4. Structures associated with the abbreviated lipidated groups designated in Table 4 are as follows:

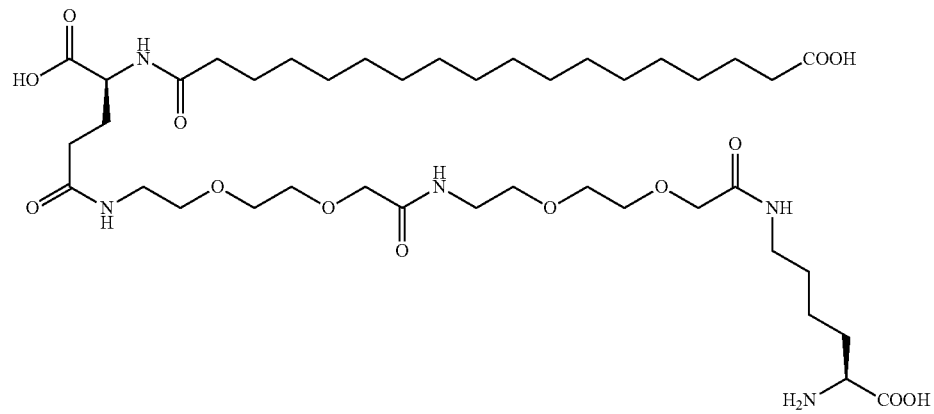

"B" = Lys(miniPEG)$_2$-gGlu-C18 diacid

-continued
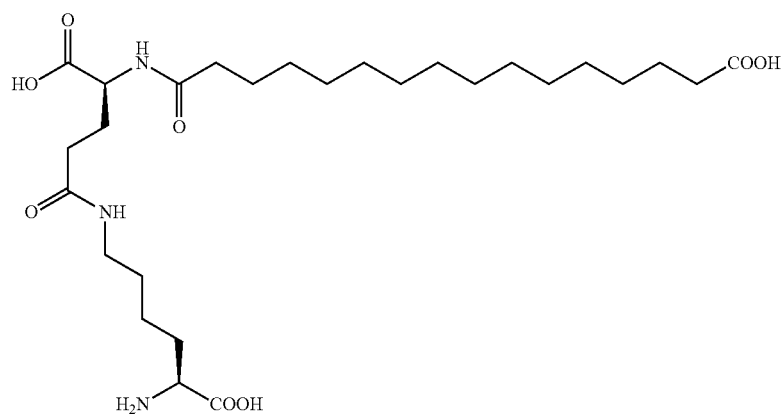
"O" = Lys(γGlu-C16 diacid)
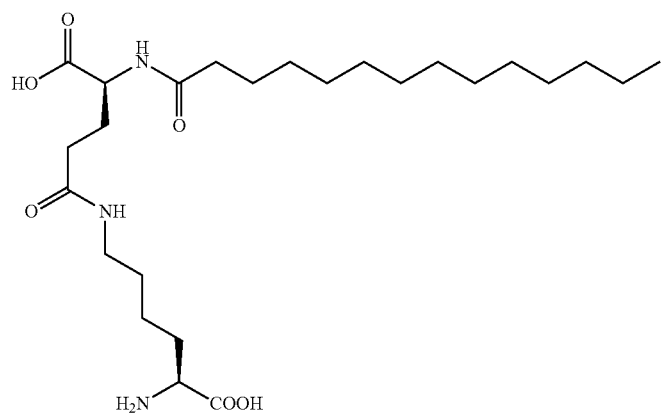
"Z" = Lys(γGlu-C14)
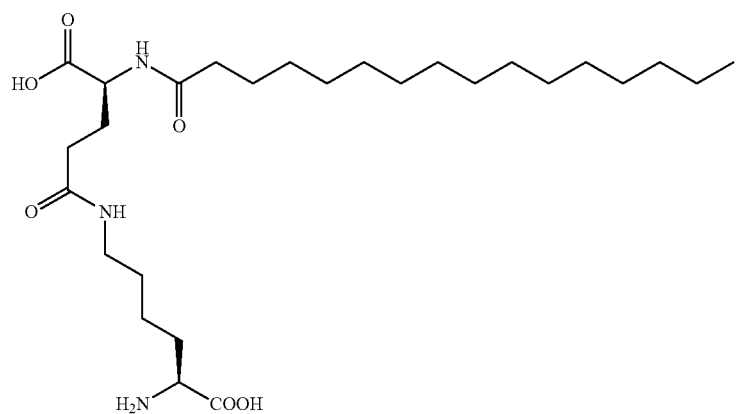
"U" = Lys(gGlu-C16)

-continued

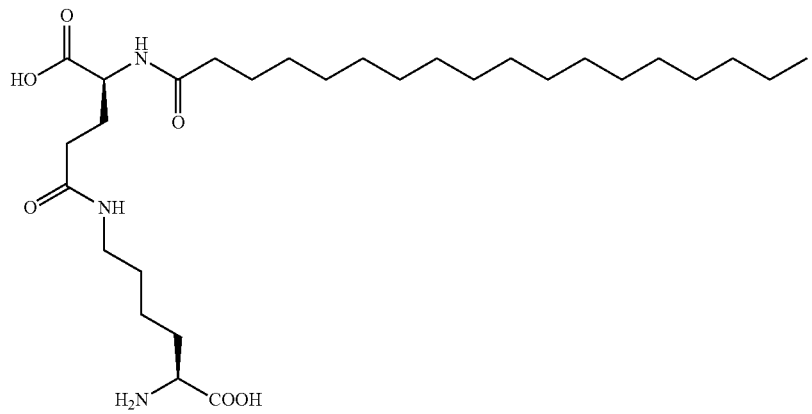

"U2" = Lys(gGlu-C18)

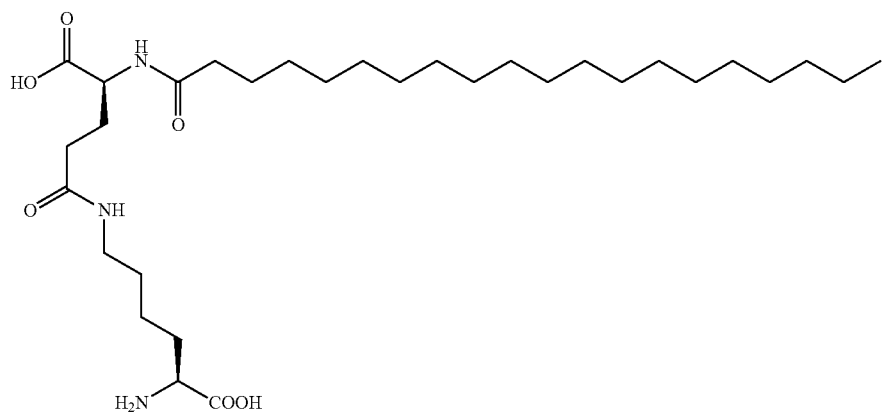

"U3" = Lys(gGlu-C20)

TABLE 4

In vitro activity of Increlins at GLP-1, GIP and Insulin B Receptors

| CIU# | Normalized GLP-1 EC50 (nM) MEAN | Normalized GIP EC50 (nM) MEAN | Normalized IR-B EC50 (nM) MEAN | Incretin Sequence | Insulin Sequence |
|---|---|---|---|---|---|
| Insulin | | | 0.5000 | | |
| GLP-1 | 0.0250 | | | HAEGTFTSDVSSYLEGQAAKEFIAWLV KGRG-OH (SEQ ID NO: 703) | |
| GIP | | 0.0025 | | YAEGTFISDYSIAMDKIHQQDFVNWLL AQKGKKNDWKHNITQ-OH (SEQ ID NO: 707) | |
| CIU-001 | 0.0122 | >10000 | 0.3220 | HXEGTFTSDVSSYLEEQAAKEFIAWLV KGGPSSGAPPPS (SEQ ID NO: 1942) | C(S-S)—CH$_2$CH$_2$CH$_2$- B$^1$ Insulin |
| CIU-002 | 0.0060 | | 0.6800 | HXEGTFTSDVSSYLEEQAAKEFIAWLV KGGPSSGAPPPSKG (SEQ ID NO: 1943) | hCys(S-S)—CH$_2$CH$_2$CH$_2$- B$^1$ Insulin |
| CIU-003 | 0.0040 | | 0.4400 | HXEGTFTSDVSSYLEEQAAKEFIAWLV KGGPSSGAPPPSKG (SEQ ID NO: 1944) | Pen(S-S)—CH$_2$CH$_2$CH$_2$- B$^1$ Insulin |
| CIU-004 | 7.9600 | | 0.5900 | XEGTFTSDVSSYLEEQAAKEFIAWLVK GGPSSGAPPPS (SEQ ID NO: 1945) | C(S-S)—CH$_2$CH$_2$CH$_2$- B$^1$ Insulin |

TABLE 4-continued

In vitro activity of Increlins at GLP-1, GIP and Insulin B Receptors

| CIU# | Normalized GLP-1 EC50 (nM) MEAN | Normalized GIP EC50 (nM) MEAN | Normalized IR-B EC50 (nM) MEAN | Incretin Sequence | Insulin Sequence |
|---|---|---|---|---|---|
| CIU-005 | 0.0034 | | 0.4980 | HXEGTFTSDVSSYLEEQAAREFIAWLV RGGPSSGAPPPS (SEQ ID NO: 1946) | C(S-S)—CH$_2$CH$_2$CH$_2$-B$^1$ Insulin |
| CIU-006 | 0.0090 | | 0.5500 | HXEGTFTSDVSSYLEEQAAKEFIAWLV KGGPSSGAPPPS (SEQ ID NO: 1947) | C(S-S)—CH(CH$_3$)CH$_2$CH$_2$-B$^1$ Insulin |
| CIU-007 | | | 0.2400 | HSQTFTSDYSKYLDSRRAQDFVQWLM NTGPSSGAPPPS (SEQ ID NO: 1948) | C(S-S)—CH$_2$CH$_2$CH$_2$-B$^1$ Insulin |
| CIU-008 | | | 0.2400 | HXQTFTSDYSKYLDSRRAQDFVQWLM NTGPSSGAPPPS (SEQ ID NO: 1949) | C(S-S)—CH$_2$CH$_2$CH$_2$-B$^1$ Insulin |
| CIU-009 | | | 0.2500 | SQGTFTSDYSKYLDSRRAQDFVQWLM NTGPSSGAPPPS (SEQ ID NO: 1950) | C(S-S)—CH$_2$CH$_2$CH$_2$-B$^1$ Insulin |
| CIU-010 | 0.0090 | | 0.4400 | HXEGTFTSDVSSYLEEQAAKEFIAWLV KGGPSSGAPPPS (SEQ ID NO: 1951) | C(S-S)—CH$_2$-Ph-CH$_2$-B$^1$ Insulin |
| CIU-011 | 0.1340 | 0.0240 | 0.6390 | YXEGTFTSDYSIYLDKQAAXEFVNWLL AGGPSSGAPPPS (SEQ ID NO: 1952) | C(S-S)—CH$_2$CH$_2$CH$_2$-B$^1$ Insulin |
| CIU-012 | 0.0029 | 1.5450 | 1.0060 | HXEGTFTSDUSSYLEEQAAKEFIAWLV KGGPSSGAPPPSG (SEQ ID NO: 1953) | C(S-S)—CH$_2$CH$_2$CH$_2$-B$^1$ Insulin |
| CIU-013 | 0.0036 | >1000 | 0.7590 | HXEGTFTSDVSSYLEEQAAKEFIAWLV KGGPSSGAPPPSGU (SEQ ID NO: 1954) | C(S-S)—CH$_2$CH$_2$CH$_2$-B$^1$ Insulin |
| CIU-014 | 0.0059 | >1000 | | HXEGTFTSDVSSYLEEQAAKEFIAWLV KGGPSSGAPPPS (SEQ ID NO: 1955) | C(S-S)—CH$_2$CH$_2$CH$_2$-B$^1$ Minipro |
| CIU-019 | 0.0060 | | 0.3390 | HXEGTFTSDVSSYLEEQAAKEFIAWLV KG (SEQ ID NO: 1956) | C(S-S)—CH$_2$CH$_2$CH$_2$-B$^1$ Insulin |
| CIU-020 | 0.7550 | | 1.2800 | XEGTFTSDVSSYLEEQAAKEFIAWLVK GGPSSGAPPPSU (SEQ ID NO: 1957) | C(S-S)—CH$_2$CH$_2$CH$_2$-B$^1$ Insulin |
| CIU-021 | 0.0041 | | 1.4330 | HXEGTFTSDUSSYLEEQAAKEFIAWLV KGGPSSGAPPPSG (SEQ ID NO: 1958) | Pen(S-S)—CH$_2$CH$_2$CH$_2$-B$^1$ Insulin |
| CIU-022 | 0.1344 | | 1.0768 | HXEGTFTSDVSSYLEEQAAKEFIAWLV KGGPSSGAPPPSU (SEQ ID NO: 1959) | Pen(S-S)—CH$_2$CH$_2$CH$_2$-B$^1$ Insulin |
| CIU-023 | 0.0142 | | 5.9750 | HXEGTFTSDVSSYLEEQAAREFIAWLV RGGPSSGAPPPS (SEQ ID NO: 1960) | C(S-S)—CH$_2$CH$_2$CH$_2$-B$^1$ Insulin (B$^{29}$ 20K PEG) |
| CIU-024 | 0.0049 | | 0.6170 | HXEGTFTSDVSSYLEEQAAREFIAWLV RGGPSSGAPPPSK (SEQ ID NO: 1961) | C(S-S)—CH$_2$CH$_2$CH$_2$-B$^1$ Insulin |
| CIU-025 | 0.0252 | | 30.6741 | HXEGTFTSDVSSYLEEQAAREFIAWLV RGPSSGAPPPSK (20K PEG) (SEQ ID NO: 1962) | C(S-S)—CH$_2$CH$_2$CH$_2$-B$^1$ Insulin (B$^{29}$ 20K PEG) |

TABLE 4-continued

In vitro activity of Increlins at GLP-1, GIP and Insulin B Receptors

| CIU# | Normalized GLP-1 EC50 (nM) MEAN | Normalized GIP EC50 (nM) MEAN | Normalized IR-B EC50 (nM) MEAN | Incretin Sequence | Insulin Sequence |
|---|---|---|---|---|---|
| CIU-032 | | | | HXEGTFTSDVSSYLEEQAAKEFIAWLV KGGPSSGAPPPSU (SEQ ID NO: 1963) | C(S-S)—CH$_2$CH$_2$CH$_2$-B$^1$ Desdi |
| CIU-033 | | | 0.9880 | YXEGTFISDYSIAMDKIHQQDFVNWLL AQKGKKNDWKHNITQ (SEQ ID NO: 1964) | C(S-S)—CH$_2$CH$_2$CH$_2$-B$^1$ Insulin |
| CIU-034 | 0.0210 | | 29.7299 | HXEGTFTSDVSSYLEEQAAREFIAWLV RGGPSSGAPPPSK (10K PEG) (SEQ ID NO: 1965) | C(S-S)—CH$_2$CH$_2$CH$_2$-B$^1$ Insulin (B29 10K PEG) |
| CIU-037 | 0.0129 | | 5.0067 | HXEGTFTSDVSSYLEEQAAREFIAWLV RGGPSSGAPPPSK(20K PEG) (SEQ ID NO: 1966) | C(S-S)—CH$_2$CH$_2$CH$_2$-B$^1$ Insulin |
| CIU-038a | | | | GTNLSVPNPLGFFPDHQLDPAFRANSN NPDWDFNPNKDHWPEANKVG (SEQ ID NO: 1967) | C(S-S)—CH$_2$CH$_2$CH$_2$-B$^1$ Insulin |
| CIU-038b | | | | C14-GTNLSVPNPLGFFPDHQLDPAFRANSN NPDWDFNPNKDHWPEANKVG (SEQ ID NO: 1968) | C(S-S)—CH$_2$CH$_2$CH$_2$-B$^1$ Insulin |
| CIU-047 | 0.0130 | | 8.2445 | HXEGTFTSDZSSYLEEQAAREFIAWLV RGGPSSGAPPPSK(20K PEG) (SEQ ID NO: 1969) | C(S-S)—CH$_2$CH$_2$CH$_2$-B$^1$ Insulin |
| CIU-048 | 0.0021 | | 1.6800 | HXEGTFTSDUSSYLEEQAAREFIAWLV RGGPSSGAPPPSK(10K PEG) (SEQ ID NO: 1970) | C(S-S)—CH$_2$CH$_2$CH$_2$-B$^1$ Insulin |
| CIU-049 | 0.0086 | | 3.7280 | HXEGTFTSDJSSYLEEQAAREFIAWLV RGGPSSGAPPPSK (SEQ ID NO: 1971) | C(S-S)—CH$_2$CH$_2$CH$_2$-B$^1$ Insulin |
| CIU-050 | | | | HXEGTFTSDVSSYLEEQAAREFIAWLV RGGPSSGAPPPS (SEQ ID NO: 1972) | C(S-S)—CH$_2$CH$_2$CH$_2$-B$^1$ Insulin PEG-5 KDa dimer |
| CIU-051 | | | | HXEGTFTSDVSSYLEEQAAREFIAWLV RGGPSSGAPPPS (SEQ ID NO: 1972) | C(S-S—CH$_2$CH$_2$CH$_2$-B$^1$ Insulin PEG-10 KDa dimer |
| CIU-052 | | | | HXEGTFTSDVSSYLEEQAAREFIAWLV RGGPSSGAPPPS (SEQ ID NO: 1972) | C(S-S)—CH$_2$CH$_2$CH$_2$-B$^1$ Insulin PEG-20 KDa dimer |
| CIU-054 | 0.0304 | | 3.1950 | HXEGTFTSDUSSYLEEQAAREFIAWLV RGGPSSGAPPPSK(20K PEG) (SEQ ID NO: 1973) | C(S-S)—CH$_2$CH$_2$CH$_2$-B$^1$ Insulin |
| CIU-055 | 0.0205 | | 1140.0000 | HXEGTFTSDVSSYLEEQAAREFIAWLV RGGPSSGAPPPSK(20K PEG) (SEQ ID NO: 1974) | C(S-S)—CH$_2$CH$_2$CH$_2$-B$^1$ DesDi |
| CIU-056 | 0.0420 | | 38.0900 | HXEGTFTSDVSSYLEEQAAREFIK (20KPEG)WLVRGGPSSGAPPPSK (20K PEG) (SEQ ID NO: 1975) | C(S-S)—CH$_2$CH$_2$CH$_2$-B$^1$ Insulin |
| CIU-057 | 0.0925 | 36.1187 | 44.2422 | HXEGTFTSDVSSYLEEQAAREFIK (10KPEG)WLVRGGPSSGAPPPSK (10K PEG) (SEQ ID NO: 1976) | C(S-S)—CH$_2$CH$_2$CH$_2$-B$^1$ Insulin |

TABLE 4-continued

In vitro activity of Increlins at GLP-1, GIP and Insulin B Receptors

| CIU# | Normalized GLP-1 EC50 (nM) MEAN | Normalized GIP EC50 (nM) MEAN | Normalized IR-B EC50 (nM) MEAN | Incretin Sequence | Insulin Sequence |
|---|---|---|---|---|---|
| CIU-058 | 1.8470 | 27.4590 | 20.4235 | HSQGTFTSDYSIYLDSRRAQDFVQWLM NTGPSSGAPPPSK(20K PEG) (SEQ ID NO: 1977) | C(S- S)—CH$_2$CH$_2$CH$_2$- B$^1$ Insulin |
| CIU-059 | 7.3185 | 0.0185 | 14.7037 | YXEGTFISDYSIYLDRQAAXEFVNWLL AGGPSSGAPPPSK(20K PEG) (SEQ ID NO: 1978) | C(S- S)—CH$_2$CH$_2$CH$_2$- B$^1$ Insulin |
| CIU-066 | | | | C14- GTNLSVPNPRGFFPDHQLDPAFRANSN NPDWDFNPNKDHWPEANKVG (SEQ ID NO: 1979) | C(S- S)—CH$_2$CH$_2$CH$_2$- B$^1$ Insulin |
| CIU-070 | | | | (HXEGTFTSDVSSYLEEQAAREFIAWLV RGGPSSGAPPPSK)$_2$PEG 10kd dimer (SEQ ID NO: 1980) | C(S-S)-B$^1$ Insulin |
| CIU-071 | | | | (HXEGTFTSDVSSYLEEQAAREFIAWLV RGGPSSGAPPPSK)$_2$PEG 20kd dimer (SEQ ID NO: 1981) | C(S-S)-B$^1$ Insulin |
| CIU-072 | | | | (HXEGTFTSDVSSYLEEQAAREFIAWLV RGGPSSGAPPPSK)S-S dimer (SEQ ID NO: 1982) | C(S-S)-B$^1$ Insulin |
| CIU-075 | 0.1555 | 5.8580 | 14.2450 | HXEGTFTSDVSSYLEEQAAREFIAWLV RGK(20K PEG)PSSGAPPPSK (20K PEG) (SEQ ID NO: 1983) | C(S- S)—CH$_2$CH$_2$CH$_2$- B$^1$ Insulin |
| CIU-076 | 0.0930 | 0.8550 | 84.0300 | HXEGTFTSDVSSYLEEQAAREFIAWLV RGK(10K PEG)PSSGAPPPSK (10K PEG) (SEQ ID NO: 1984) | C(S- S)—CH$_2$CH$_2$CH$_2$- B$^1$ Insulin |
| CIU-077 | 130.9600 | 0.0270 | 7.0090 | YXEGTFISDYSIAMDRIHQXDFVNWLLA QRGRRNDWRHNITQK(20K PEG) (SEQ ID NO: 1985) | C(S- S)—CH$_2$CH$_2$CH$_2$- B$^1$ Insulin |
| CIU-078 | 39.7900 | 0.0110 | 6.4250 | YXEGTFISDYSIAMDRIHQXDFVNWLL AGGPSSGAPPPSK(20K PEG) (SEQ ID NO: 1986) | C(S- S)—CH$_2$CH$_2$CH$_2$- B$^1$ Insulin |
| CIU-079 | 0.0149 | 0.0009 | 1.6981 | YXEGTFTSDUSIYLDKQAAXEFVNWLL AGGPSSGAPPPS (SEQ ID NO: 1987) | C(S- S)—CH$_2$CH$_2$CH$_2$- B$^1$ Insulin |
| CIU-082 | 0.1254 | 0.0033 | 1.6918 | YXEGTFTSDYSIYLDKQAAXEFVNWLL AGGPSSGAPPPSU (SEQ ID NO: 1988) | C(S- S)—CH$_2$CH$_2$CH$_2$- B$^1$ Insulin |
| CIU-083 | 0.5370 | 14.6030 | 3.2280 | HSQGTFTSDYSIYLDXRRAQDFVQWL MNTGPSSGAPPPSK(20K PEG) (SEQ ID NO: 1989) | C(S- S)—CH$_2$CH$_2$CH$_2$- B$^1$ Insulin |
| CIU-084 | 0.3530 | 9.1340 | 4.6900 | HSQGTFISDYSIYLDXRRAQDFVQWLM NTGPSSGAPPPSK(20K PEG) (SEQ ID NO: 1990) | C(S- S)—CH$_2$CH$_2$CH$_2$- B$^1$ Insulin |
| CIU-085 | 0.0109 | 0.0010 | 735.0000 | YXEGTFTSDUSIYLDKQAAXEFVNWLL AGGPSSGAPPPS (SEQ ID NO: 1991) | C(S- S)—CH$_2$CH$_2$CH$_2$- B$^1$ DesDi |
| CIU-089 | 0.0062 | 0.0710 | 1.1990 | HXEGTFTSDUSRYLDERAAQEFVAWL LDAGPSSGAPPPSK (SEQ ID NO: 1992) | C(S- S)—CH$_2$CH$_2$CH$_2$- B$^1$ Insulin |

TABLE 4-continued

In vitro activity of Increlins at GLP-1, GIP and Insulin B Receptors

| CIU# | Normalized GLP-1 EC50 (nM) MEAN | Normalized GIP EC50 (nM) MEAN | Normalized IR-B EC50 (nM) MEAN | Incretin Sequence | Insulin Sequence |
|---|---|---|---|---|---|
| CIU-090 | 0.0064 | 0.0090 | 1.1230 | HXQGTFTSDUSRYLDERAAQDFVQWLLDAGPSSGAPPPSK (SEQ ID NO: 1993) | C(S-S)—CH$_2$CH$_2$CH$_2$-B$^1$ Insulin |
| CIU-091 | 0.0090 | 0.0410 | 1.1070 | HXQGTFTSDUSRYLDERAAQDFVQWLLDGGPSSGAPPPSK (SEQ ID NO: 1994) | C(S-S)—CH$_2$CH$_2$CH$_2$-B$^1$ Insulin |
| CIU-092 | 0.0057 | 0.2220 | 2.8845 | HXEGTFTSDUSRYLDERAAQDFVQWLLDGGPSSGAPPPSK (SEQ ID NO: 1995) | C(S-S)—CH$_2$CH$_2$CH$_2$-B$^1$ Insulin |
| CIU-093 | 0.4370 | 0.9640 | 1.8410 | XEGTFTSDUSIYLDKQAAXEFVNWLLAGGPSSGAPPPS (SEQ ID NO: 1996) | C(S-S)—CH$_2$CH$_2$CH$_2$-B$^1$ Insulin |
| CIU-094 |  | 9.8850 | 8.0670 | HSQGTFTSDYSRYLDSRRAQDFVQWLMNTGPSSGAPPPSK(20K PEG) (SEQ ID NO: 1997) | C(S-S)—CH$_2$CH$_2$CH$_2$-B$^1$ Insulin |
| CIU-095 | 1.2970 | >10000 | 16.0590 | HXEGTFTSDYSKYLDERAABDFVQWLLEGGPSSGAPPPS (SEQ ID NO: 1998) | C(S-S)—CH$_2$CH$_2$CH$_2$-B$^1$ Insulin |
| CIU-096 | 0.7770 | >10000 | 15.3000 | HXEGTFTSDBSKYLDERAAQDFVQWLLEGGPSSGAPPPS (SEQ ID NO: 1999) | C(S-S)—CH$_2$CH$_2$CH$_2$-B$^1$ Insulin |
| CIU-097 | 0.4160 | 3.4120 | 21.8550 | HXEGTFTSDYSKYLDERAAQDFVQWLLEGGPSSGAPPPSB (SEQ ID NO: 2000) | C(S-S)—CH$_2$CH$_2$CH$_2$-B$^1$ Insulin |
| CIU-098 | 0.0033 | 5.5450 | 135.6000 | HXEGTFTSDYSKYLDERAAQDFVQWLLEGGPSSGAPPPS (SEQ ID NO: 2001) | C(S-S)—CH$_2$CH$_2$CH$_2$-B$^1$ Insulin (B$^{29}$B) |
| CIU-106 | 0.0132 | 0.0071 | 154.1400 | YXEGTFTSDYSIYLDKQAAXEFVNWLLAGGPSSGAPPPS (SEQ ID NO: 2002) | C(S-S)—CH2CH2CH2-B1 Insulin (B$^{29}$B) |
| CIU-107 | 2.9380 | 1.2550 | 6.2400 | YXEGTFTSDBSIYLDKQAAXEFVNWLLAGGPSSGAPPPS (SEQ ID NO: 2003) | C(S-S)—CH$_2$CH$_2$CH$_2$-B$^1$ Insulin |
| CIU-108 | 2.8060 | 0.1860 | 5.5300 | YXEGTFTSDYSIYLDKQAAXEFVNWLLAGGPSSGAPPPSB (SEQ ID NO: 2004) | C(S-S)—CH$_2$CH$_2$CH$_2$-B$^1$ Insulin |
| CIU-112 | 1.0090 | 0.0800 | 1.7790 | YXEGTFTSDYSIYLDKQAAXEFVNWLLAGGPSSGAPPPSO (SEQ ID NO: 2005) | C(S-S)—CH$_2$CH$_2$CH$_2$-B$^1$ Insulin |
| CIU-113 | 2.2715 | 0.8010 | 2.0800 | YXEGTFTSDOSIYLDKQAAXEFVNWLLAGGPSSGAPPPS (SEQ ID NO: 2006) | C(S-S)—CH$_2$CH$_2$CH$_2$-B$^1$ Insulin |
| CIU-114 | 0.0180 | 0.0130 | 11.6470 | YXEGTFTSDYSIYLDKQAAXEFVNWLLAGGPSSGAPPPS (SEQ ID NO: 2007) | C(S-S)—CH$_2$CH$_2$CH$_2$-B$^1$ Insulin (B$^{29}$-O) |
| CIU-115 | 0.0048 | 0.5530 |  | HXEGTFTSDUSSYLEEQAAKEFVNWLLAGGPSSGAPPPS (SEQ ID NO: 2008) | C(S-S)—CH$_2$CH$_2$CH$_2$-B$^1$Desdi |
| CIU-116 | 2.0630 | 0.0010 |  | YXEGTFISDUSIYLDKQAAXEFVNWLLAGGPSSGAPPPS (SEQ ID NO: 2009) | C(S-S)—CH$_2$CH$_2$CH$_2$-B$^1$Desdi |

TABLE 4-continued

In vitro activity of Increlins at GLP-1, GIP and Insulin B Receptors

| CIU# | Normalized GLP-1 EC50 (nM) MEAN | Normalized GIP EC50 (nM) MEAN | Normalized IR-B EC50 (nM) MEAN | Incretin Sequence | Insulin Sequence |
|---|---|---|---|---|---|
| CIU-117 | 0.0845 | 0.0346 | 163.4700 | YXEGTFTSDUSIYLDKQAAXEFVNWLLAGGPSSGAPPPS (SEQ ID NO: 2010) | C(S-S)—CH$_2$CH$_2$CH$_2$-B$^1$ Insulin (B$^{29}$-O) |
| CIU-118 | 0.0110 | 0.0034 | 1.5800 | YXEGTFTSDUSIYLDKQAAXEFVNWLLAGGPSSGAPPPS (SEQ ID NO: 2011) | C(S-S)—CH$_2$CH$_2$CH$_2$-B$^1$ (H$_2$NCO-A$^1$) Insulin |
| CIU-119 | 0.0170 | 0.0035 | 6.1900 | YXEGTFTSDUSIYLDKQAAXEFVNWLLAGGPSSGAPPPS (SEQ ID NO: 2012) | C(S-S)-CH$_2$CH$_2$CO-B$^{29}$Insulin |
| CIU-123 | 0.0032 | 0.0036 | | HXEGTFTSDUSIYLDKQAAXEFVNWLLAGGPSSGAPPPS (SEQ ID NO: 2013) | C(S-S)—CH$_2$CH$_2$CH$_2$-B$^1$Desdi |
| CIU-146 | 0.0110 | 0.0014 | | YXEGTFTSDU2SIYLDKQAAXEFVNWLLAGGPSSGAPPPS (SEQ ID NO: 2014) | C(S-S)—CH$_2$CH$_2$CH$_2$-B$^1$Desdi |
| CIU-147 | 0.0130 | 0.0020 | | YXEGTFTSDU3SIYLDKQAAXEFVNWLLAGGPSSGAPPPS (SEQ ID NO: 2015) | C(S-S)—CH$_2$CH$_2$CH$_2$-B$^1$Desdi |
| CIU-173 | | | | YXEGTFTSDUSIYLDKQAAXEFVNWLLAGGPSSGAPPPS (SEQ ID NO: 2016) | C(S-S)—CH$_2$CH$_2$CH$_2$-B$^1$ Insulin (Lys B$^{29}$-LCB) |
| CIU-178 | 0.4500 | 0.0580 | | YXEGTFTSDBSIYLDKQAAXEFVNWLLAGGPSSGAPPPS (SEQ ID NO: 2017) | C(S-S)—CH$_2$CH$_2$CH$_2$-B$^1$Desdi |
| CIU-179 | 0.1060 | 0.0200 | | YXEGTFTSDUSIYLDKQAAXEFVNWLLAGGPSSGAPPPSU (SEQ ID NO: 2018) | C(S-S)—CH$_2$CH$_2$CH$_2$-B$^1$Desdi |
| CIU-190 | 8.5800 | 0.0021 | 3.0110 | YXEGTFISDYSIYLDKQAAXEFVNWLLAGGPSSGAPPPSU (SEQ ID NO: 2019) | C(S-S)—CH$_2$CH$_2$CH$_2$-B$^1$ Insulin |
| CIU-191 | 0.1113 | 0.0026 | >1000 | YXEGTFTSDYSIYLDKQAAXEFVNWLLAGGPSSGAPPPSU (SEQ ID NO: 2020) | C(S-S)—CH$_2$CH$_2$CH$_2$-B$^1$Desdi |
| CIU-192 | >10 | 4.9570 | 1.4895 | XEGTFTSDYSIYLDKQAAXEAVNWLLAGGPSSGAPPPSU (SEQ ID NO: 2021) | C(S-S)—CH$_2$CH$_2$CH$_2$-B$^1$ Insulin |
| CIU-197 | 0.0149 | 9.4060 | 2.5850 | HXEGTFTSDVSSYLEEQAAKEFIAWLVKGGPSSGAPPPSU (SEQ ID NO: 2022) | C(S-S)—CH$_2$CH$_2$CH$_2$-B$^1$ Insulin |
| CIU-216 | 0.0160 | 0.3360 | | HXEGTFTSDVSSYLEKQAAXEFVNWLLAGGPSSGAPPPSU (SEQ ID NO: 2023) | C(S-S)—CH$_2$CH$_2$CH$_2$-B$^1$ Insulin |
| CIU-225 | 0.0130 | 1.0100 | 4.4400 | HXEGTFTSDVSIYLDKQAAXEFVNWLLAGGPSSGAPPPSU (SEQ ID NO: 2024) | C(S-S)—CH$_2$CH$_2$CH$_2$-B$^1$ Insulin |

Abbreviations: X = Aib, U = K(rEC16), Z = K(rEC14), J = K(succinoylC16), B = K(miniPEG)2-rGlu-C18 diacid, O = K(rGlu-C16 diacid)

EXAMPLE 14

Determination of Rate of Model Dipeptide Cleavage (in PBS)

A specific hexapeptide (HSRGTF-NH$_2$; SEQ ID NO: 2036) was used as a model peptide upon which the rate of cleavage of dipeptide N-terminal extensions could be studied. The dipeptide-extended model peptides were prepared Boc-protected sarcosine and lysine were successively added to the model peptide-bound resin to produce peptide A (Lys-Sar-HSRGTF-NH$_2$; SEQ ID NO: 2036). Peptide A was cleaved by HF and purified by preparative HPLC.

The rate of cleavage was determined for the respective propeptides. The concentrations of the propeptides and the model parent peptide were determined by their respective peak areas. The first order dissociation rate constants of the prodrugs were determined by plotting the logarithm of the concentration of the prodrug at various time intervals. The slope of this plot provides the rate constant 'k'. The half-lives for cleavage of the various prodrugs were calculated by using the formula $t_{1/2}$=0.693/k. The half-life of the Lys-Sar extension to this model peptide HSRGTF-NH$_2$ (SEQ ID NO: 2036) was determined to be 14.0 h.

EXAMPLE 15

Rate of Dipeptide Cleavage Half Time in Plasma as Determined with an all d-isoform Model Peptide An additional model hexapeptide (dHdTdRGdTdF-NH$_2$ SEQIDNO: 21) was used to determine the rate of dipeptide cleavage in plasma. The d-isomer of each amino acid was used to prevent enzymatic cleavage of the model peptide, with the exception of the prodrug extension. This model d-isomer hexapeptide was synthesized in an analogous fashion to the 1-isomer. The sarcosine and lysine were successively added to the N-terminus as reported previously for peptide A to prepare peptide B (dLys-dSar-dHdTdRGdTdF-NH$_2$ SEQ ID NO: 59)

The rate of cleavage was determined for the respective propeptides. The concentrations of the propeptides and the model parent peptide were determined by their respective peak areas. The first order dissociation rate constants of the prodrugs were determined by plotting the logarithm of the concentration of the prodrug at various time intervals. The slope of this plot provides the rate constant 'k'. The half-life of the Lys-Sar extension to this model peptide dHdT-dRGdTdF-NH$_2$ (SEQ ID NO: 21) was determined to be 18.6 h.

EXAMPLE 16

The rate of cleavage for additional dipeptides linked to the model hexapeptide (HSRGTF-NH$_2$; SEQ ID NO: 2036) were determined using the procedures described in Example 5. The results generated in these experiments are presented in Tables 2 and 3.

TABLE 2

Cleavage of the Dipeptides O-U that are linked to the side chain of an N-terminal para-amino-Phe from the Model Hexapeptide (HSRGTF-NH$_2$; SEQ ID NO: 2036) in PBS

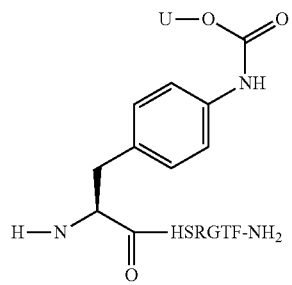

| Compounds | U (amino acid) | O (amino acid) | $t_{1/2}$ |
| --- | --- | --- | --- |
| 1 | F | P | 58 h |
| 2 | Hydroxyl-F | P | 327 h |
| 3 | d-F | P | 20 h |
| 4 | d-F | d-P | 39 h |
| 5 | G | P | 72 h |
| 6 | Hydroxyl-G | P | 603 h |
| 7 | L | P | 62 h |
| 8 | tert-L | P | 200 h |
| 9 | S | P | 34 h |
| 10 | P | P | 97 h |
| 11 | K | P | 33 h |
| 12 | dK | P | 11 h |
| 13 | E | P | 85 h |
| 14 | Sar | P | ≈1000 h |
| 15 | Aib | P | 69 min |
| 16 | Hydroxyl-Aib | P | 33 h |
| 17 | cyclohexane | P | 6 min |
| 18 | G | G | No cleavage |
| 19 | Hydroxyl-G | G | No cleavage |
| 20 | S | N-Methyl-Gly | 4.3 h |
| 21 | K | N-Methyl-Gly | 5.2 h |
| 22 | Aib | N-Methyl-Gly | 7.1 min |
| 23 | Hydroxyl-Aib | N-Methyl-Gly | 1.0 h |

TABLE 3

Cleavage of the Dipeptides U-O linked to histidine (or histidine derivative) at position 1 (X) from the Model Hexapeptide (XSRGTF-NH$_2$; SEQ ID NO: 59) in PBS
NH$_2$-U-O-XSRGTF-NH$_2$

| Cmp | U (amino acid) | O (amino acid) | X (amino acid) | $t_{1/2}$ |
| --- | --- | --- | --- | --- |
| 1 | F | P | H | No cleavage |
| 2 | Hydroxyl-F | P | H | No cleavage |
| 3 | G | P | H | No cleavage |
| 4 | Hydroxyl-G | P | H | No cleavage |
| 5 | A | P | H | No cleavage |
| 6 | C | P | H | No cleavage |
| 7 | S | P | H | No cleavage |
| 8 | P | P | H | No cleavage |
| 9 | K | P | H | No cleavage |
| 10 | E | P | H | No cleavage |
| 11 | Dehydro V | P | H | No cleavage |
| 12 | P | d-P | H | No cleavage |
| 13 | d-P | P | H | No cleavage |
| 14 | Aib | P | H | 32 h |
| 15 | Aib | d-P | H | 20 h |
| 16 | Aib | P | d-H | 16 h |
| 17 | Cyclohexyl- | P | H | 5 h |
| 18 | Cyclopropyl- | P | H | 10 h |
| 19 | N—Me-Aib | P | H | >500 h |
| 20 | α,α-diethyl-Gly | P | H | 46 h |
| 21 | Hydroxyl-Aib | P | H | 61 |
| 22 | Aib | P | A | 58 |
| 23 | Aib | P | N-Methyl-His | 30 h |
| 24 | Aib | N-Methyl-Gly | H | 49 min |

TABLE 3-continued

Cleavage of the Dipeptides U-O linked to histidine (or histidine derivative) at position 1 (X) from the Model Hexapeptide (XSRGTF-NH$_2$; SEQ ID NO: 59) in PBS
NH$_2$-U-O-XSRGTF-NH$_2$

| Cmp | U (amino acid) | O (amino acid) | X (amino acid) | $t_{1/2}$ |
|---|---|---|---|---|
| 25 | Aib | N-Hexyl-Gly | H | 10 min |
| 26 | Aib | Azetidine-2-carboxylic acid | H | >500 h |
| 27 | G | N-Methyl-Gly | H | 104 h |
| 28 | Hydroxyl-G | N-Methyl-Gly | H | 149 h |
| 29 | G | N-Hexyl-Gly | H | 70 h |
| 30 | dK | N-Methyl-Gly | H | 27 h |
| 31 | dK | N-Methyl-Ala | H | 14 h |
| 32 | dK | N-Methyl-Phe | H | 57 h |
| 33 | K | N-Methyl-Gly | H | 14 h |
| 34 | F | N-Methyl-Gly | H | 29 h |
| 35 | S | N-Methyl-Gly | H | 17 h |
| 36 | P | N-Methyl-Gly | H | 181 h |

In addition various prodrug derivatives of IGF1YL insulin analogs have been prepared wherein a dipeptide element has been linked via an amide bond through the 4-amino-phenylalanine residue present at A19 of the IGF1YL. The in vitro analysis of these compounds using the procedures of Example 5 reveals that the activity of these compounds increases with time incubated in either a PBS buffer or in 20% plasma. In addition, the in vitro activity of the IGF analog prodrug MIU30: A1(aF19-dLys(Ac),Sar) (dipeptide linked through and amide bond to the A19 4-aminoPhe) was measured for insulin receptor binding relative to native insulin over time (1 hour, 3 hours, 6 hours, 9 hours and 10.5 hours) incubated in 20% plasma. Table 3A compares the relative insulin receptor binding of over time incubated in 20% plasma/PBS at 37° C. As indicated by the data presented in an in vitro binding assay, see Table 3A and an in vitro phosphorylation assay, see Table 3B, increased activity is recovered from the A19 IGF prodrug derivative sample over time, as the prodrug form is converted to the active IGF1YL peptide.

TABLE 3A

| Time (hr) | % Activity of Insulin |
|---|---|
| 0 | 34.44% |
| 9 | 100.09% |
| 95 | 115.42% |

TABLE 3B

| Time (hr) | % Activity of Insulin |
|---|---|
| 1 | 23.0 |
| 3 | 26.8 |
| 6 | 32.5 |
| 9 | 41.1 |
| 10.5 | 43.2 |

Figure 8:
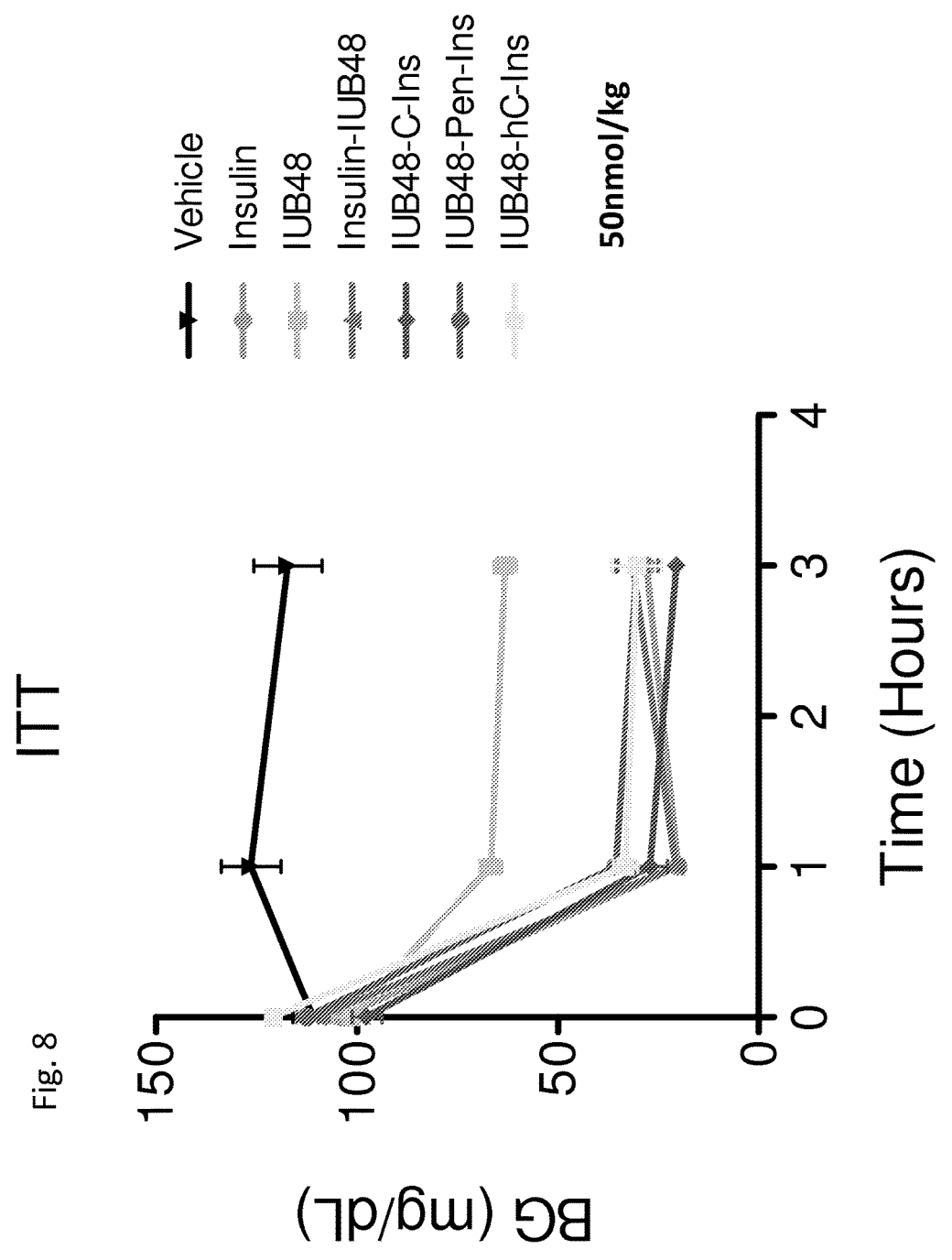

In vivo glucose tolerance tests using C57/Blk mice administered insulin analog MIU-30a:B$^1$(Y16,L17,Y25) 29a:A$^1$(dLys(Ac),Sar-aF19) (dipeptide linked through and amide bond to the A19 4-aminoPhe), MIU 30 dissolved in PBS (pH 7.4) with 20% plasma and incubated for 48 hours at 37° C. (generating "MIU-30c"). Samples incubated for 0 hr (MIU 30a) and 48 hr (MIU 30c) were withdrawn and injected to C57 black mice at 90 nmol/kg and 270 nmol/kg to measure glucose lowering (insulin tolerance test). In FIG. 8A the glucose lowering profile of MIU 30a and MIU 30c at various times through 8 hr are shown. The parent compound has low potency, but after incubation in 20% plasma for 48 hours (generating "MIU-30c") potency is increased (See FIG. 8A). In FIG. 8B total blood glucose of MIU 30a and MIU 30c as compared to vehicle is reported as differential area under curve (AUC). At 90 nmol/kg, MIU 30a indicates little change in glucose, while MIU 30c causes a sizable decrease. At 270 nmol/kg, both MIU 30a and MIU 30c demonstrate glucose lowering, but the latter sample possesses significantly more hypoglycemic potency. In summary, the prodrug form of the insulin analog MIU30 shows appreciably lesser glucose lowering potency when injected prior to ex vivo conversion under physiological conditions to the parent insulin analog. These in vivo results are consistent with the in vitro analysis. The half-life of the prodrug is estimated to be approximately 20 hours.

EXAMPLE 17

Dipeptide Cleavage from Prodrug Forms of IGFB 16B17 Derivative Peptides

The cleavage of an (pNH2-Phe) amide linked dipeptide AibPro from various IGF-1 peptides was measured to determine the impact of the peptide sequence or heteroduplex on the dipeptide cleavage. Results for the tested peptides is shown in Table 11 and the data reveals that the IGF1-A chain alone represents a good model for the study of prodrug half-life for IGF1 B:A (YL)$^{B16,17}$ peptides.

TABLE 11

| Parent Peptide | Half Life (hr) |
|---|---|
| IGF1A(Ala)$^{6, 11, 20}$(pNH$_2$-Phe)$^{A19}$ | 2.2 |
| IGF1A(Acm)$^{6, 11, 20}$(pNH$_2$-Phe)$^{A19}$ | 1.8 |
| IGF1 B:A(S-S)$^{A7, B7}$(Acm)$^{A6, 11, 20, B19}$(pNH$_2$-Phe)$^{A19}$ | 1.8 |
| IGF1 B:A(pNH$_2$-Phe)$^{A19}$ | 1.6 |

Comparison of prodrug derivatives of the IGF A-chain relative to the disulfide bound A chain and B chain construct (IGF1 A:B(Y$^{B16}$L$^{B17}$) revealed the two compounds had similar half-lives for the prodrug form. Accordingly, the IGF1A chain alone was determined to be a good model for the study of pro-drug half-life on IGF1 B:A (Y$^{B16}$L$^{B17}$). Note the AibAla derivative does not cleave and thus is not a prodrug, but serves to show the modification can inactivate the insulin analog IGF1 A:B(Y$^{B16}$L$^{B17}$)(p-NH$_2$—F)$^{A19}$amide. For simplicity, prodrug half-lives were determined using only the IGF1 A chain in the absence of the B chain. The half-lives of each propeptide was determined as described in Example 5. The data is presented in Table 12:

TABLE 12

Dipeptide half life on IGF1 dipeptide extended (p-NH$_2$—F)$^{419}$ amide

| Dipeptide | | Half Life (hr) |
|---|---|---|
| Aib | Pro | 2.2 |
| AibOH | Pro | 165.0 |
| Aib | dPro | 1.9 |
| AibOH | Sar | 2.3 |
| dK(acetyl) | Sar | 16.3 |
| K | Sar | 21.8 |
| K(acetyl) | N-methyl Ala | 23.6 |
| dK(acetyl) | N-methyl Ala | 35.3 |

The data shows that by altering the substituents on the dipeptide prodrug element that the half-life of prodrug can be varied from 2 hrs to >100 hrs.

Additional prodrug derivative peptides were prepared using an IGF1-A(pNH2-F)[19] base peptide and altering the amino acid composition of the dipeptide prodrug element linked through the 4-amino phenylalanine at position A19. Dipeptide half-lives were measured for different constructs both in PBS and in 20% plasma/PBS (i.e. in the presence of serum enzymes. The results are provided in Table 13. The results indicate that three of the four peptides tested were not impacted by serum enzymes.

EXAMPLE 18

Biosynthesis and Purification of Single Chain Insulin Analogs

An insulin-IGF-I minigene comprising a native insulin B and A chain linked via the IGF-I C chain ($B^0$-$C^1$-$A^0$) was cloned into expression vector pGAPZtα A (purchased from Invitrogen) under GAP promoter (promoter of the glyceraldehyde-3-phosphate dehydrogenase (GAPDH)) for constitutive expression and purification of recombinant protein in yeast Pichia pastoris. The minigene was fused to an N-terminal peptide encoding Saccharomyces cerevisiae α-mating factor leader signal for secretion of the recombinant protein into the medium. A Kex2 cleavage site between the minigene and the leading α-mating factor sequence was used to cleave the leader sequence for secretion of the minigene with native amino termini. Single-site alanine mutations were introduced into C peptide at positions 1 (G1A), 2 (Y2A), 3 (G3A), 4 (S4A), 5 (S5A), 6 (S6A), 7 (R7A), 8 (R8A), 10 (P10A), 11 (Q11A), and 12 (T12A) of the $B^0$-$C^1$-$A^0$ minigene.

The minigenes including $B^0$-$C^1$-$A^0$, eleven alanine mutants, and other select derivatives were transformed into yeast Pichia pastoris by electroporation. Positive transformants were selected on minimal methanol plates and a genomic preparation of each Pichia isolate was performed and integration of the constructs into the yeast genome was confirmed by PCR. An 833 base pair PCR product was visualized on an agarose DNA gel. The insulin analogs were produced by fermentation of a corresponding yeast line. The yeast cells were pelleted by centrifugation at 5 K for 20 minutes in 500 ml Beckman centrifuge tubes and the media was kept for subsequent protein purification.

Growth media supernatants were filtered through 0.2 μm Millipore filter. Acetonitrile (ACN) was added to the supernatant to a final volume of 20%. The supernatant was purified over a Amberlite XAD7HP resin from Sigma, pre-equilibrated with 20% aqueous ACN. The resin was then rinsed twice with 30 ml of 20% aqueous ACN and contaminants were removed with 30% aqueous ACN containing 0.1% TFA. Partially purified insulin analogs were eluted from the column with 54% aqueous ACN containing 0.1% TFA and lyophilized. Lyophilized samples were re-suspended in 0.025M $NH_3HCO_3$ pH 8 and purified on a Luna C18 column (10 μm particle size, 300A° pore size). Protein was eluted from the column using a linear gradient of 20-60% aqueous ACN. MALDI-MS positive fractions were pooled and transferred to a disposable scintillation vial for subsequent lyophilization. Lyophilized samples were then resuspended in 20% aqueous ACN containing 0.1% TFA, and purified on a Luna C18 column (10 μm particle size, 300A° pore size). The protein was eluted from the column using a linear gradient of 18-54% aqueous ACN with 0.1% TFA. Protein elution was monitored at an absorbance 280 nm. MALDI-TOF MS positive fractions were analyzed via a C8 analytical column to insure purity.

The $B^0$-$C^1$-$A^0$ analog demonstrated potency that was equally effective at both insulin receptor isoforms and the IGF-1 receptor. Mutation of the tyrosine at position 2 to alanine or the shortening of the C-peptide to eight amino acids through deletion of C9-12 provided a selective enhancement in the specificity of insulin action by significant reduction in the IGF-1 receptor activity. See the data provided in Tables 14A and 14B:

TABLE 14A

Insulin Binding & Phosphorylation Analysis ($B^0C^1A^0$)

| Peptide | Insulin Binding IC$_{50}$, nM | n | Insulin Phosphorylation EC$_{50}$, nM | n |
|---|---|---|---|---|
| Insulin | 0.54 ± 0.02 | 4 | 1.67 ± 0.13 | 1 |
| IGF-1 | 18.81 ± 1.77 | 3 | 29.20 ± 8.41 | 1 |
| 010 ($B^0C^1A^0$) | 2.83 ± 0.52 | 2 | 1.93 ± 0.43 | 1 |
| G1A | 1.21 ± 0.15 | 1 | 2.4 ± 0.24 | 1 |
| Y2A | 1.95 ± 0.28 | 3 | 1.86 ± 0.42 | 1 |
| G3A | 1.41 ± 0.05 | 2 | 2.13 ± 0.02 | 1 |
| S4A | 0.84 ± 0.47 | 2 | 0.76 ± 0.35 | 1 |
| S5A | 0.93 ± 0.44 | 1 | 2.23 ± 1.27 | 1 |
| S6A | 1.15 ± 0.24 | 1 | 2.33 ± 1.65 | 2 |
| R7A | 6.04 ± 0.82 | 1 | 5.21 ± 4.14 | 1 |
| R8A | 0.63 ± 0.09 | 1 | 2.03 ± 0.06 | 2 |
| P10A | 2.86 ± 0.93 | 1 | 2.59 ± 1.2 | 1 |
| Q11A | 1.79 ± 0.47 | 1 | 2.58 ± 0.83 | 1 |
| T12A | 1.2 ± 0.18 | 1 | 2.83 ± 1.31 | 1 |

TABLE 14B

IGF-1 Binding & Phosphorylation Analysis ($B^0C^1A^0$)

| Peptide | IGF-1 Binding IC$_{50}$, nM | n | IGF-1 Phosphorylation EC$_{50}$, nM | n |
|---|---|---|---|---|
| Insulin | 60.63 ± 4.43 | 1 | 48.66 ± 1.59 | 1 |
| IGF-1 | 0.38 ± 0.07 | 1 | 0.88 ± 0.41 | 1 |
| 010 ($B^0C^1A^0$) | 4.49 ± 1.04 | 1 | 1.29 ± 2.28 | 1 |
| G1A | 42.36 ± 16.24 | 1 | 1.4 ± 0.62 | 1 |
| Y2A | 257.9 ± 29.59 | 1 | 35.6 ± 14.55 | 1 |
| G3A | 34.02 ± 16.09 | 1 | 7.85 ± 0.78 | 1 |
| S4A | 15.30 ± 3.10 | 1 | 1.64 ± 1.65 | 1 |
| S5A | 13.06 ± 3.01 | 1 | 2.63 ± 1.88 | 1 |
| S6A | 2.44 ± 0.79 | 1 | 1.54 ± 0.62 | 2 |
| R7 | 43.86 ± 8.72 | 1 | 1.26 ± 1.55 | 1 |
| R8 | 10.85 ± 1.47 | 1 | 0.50 ± 0.23 | 2 |
| P10A | 6.42 ± 0.47 | 1 | 2.79 ± 1.12 | 1 |
| Q11A | 4.23 ± 0.43 | 1 | 0.41 ± 0.69 | 1 |
| T12A | 9.15 ± 0.83 | 1 | 1.44 ± 1.36 | 1 |

The most insulin selective analogs were those that we missing the last four residues of the C-peptide, had an alanine mutation at position two of the C-peptide, or a combination of the two changes.

TABLE 13

Dipeptide half life on IGF1-A(pNH2—F)[19]

| | | Half Life (hr) | |
|---|---|---|---|
| | | PBS | 20% Plasma/PBS |
| Aib | Pro | 2.2 | 2.1 |
| Aib | dPro | 2.1 | 2.2 |

TABLE 13-continued

Dipeptide half life on IGF1-A(pNH2—F)[19]

| | | Half Life (hr) | |
|---|---|---|---|
| | | PBS | 20% Plasma/PBS |
| AibOH | Sar | 2.3 | |
| dK | N-isobutyl Gly | 4.4 | 4.1 |
| dK | N-hexyl Gly | 10.6 | |
| dK(acetyl) | Sar | 17.2 | |
| K | Sar | 21.8 | 5.9 |
| K(acetyl) | N-methyl Ala | 23.6 | |
| dK(acetyl) | N-methyl Ala | 35.3 | |
| AibOH | Pro | 165.0 | |
| K(acetyl) | Azetidine-2-carboxylic acid | Not cleavable | |
| dK(acetyl) | Azetidine-2-carboxylic acid | Not cleavable | |

EXAMPLE 19

Insulin Tolerance Tests

Single Administration

Six- to eight-week-old male C57BL/6 mice were maintained at 23° C., constant humidity, and a 12-h light-dark cycle. The acute in vivo effects of select peptides were evaluated by subcutaneously injecting peptides solubilized in physiologically buffered saline or a vehicle control to normal or diabetic mice. Blood glucose was measured at various time points through the course of a 24 hr period following administration of the peptides. Each group of mice contained 8 animals per group. The average body weight was ~25 g. Mice were made diabetic by administration of streptozotocin.

Serial Administration

Repeat daily subcutaneous administration of the peptides or vehicle control was administered to the mice for periods of five days to two weeks. The obese mice were given a diabetogenic diet Mice had free access to water and were fed ad libitum with a high fat diet (HFD) comprising 58% of calories from fat (D12331; Research Diets, New Brunswick, N.J.) and each group of mice contained 8 animals per group. The average body weight was ~50 g and the mice were ~6 months old males. Body weight and food intake were measured on the days that peptide or vehicle control was administered to the mice. Fasting blood glucose levels were measured repeatedly.

EXAMPLE 20

Procedure for Graded Glucose Infusion in Cynomolgus Monkeys

Twelve non-naïve male monkeys were selected from a colony, single housed, maintained on a standard 12:12-hour light-dark cycle at 22° C. with free access to a standard chow diet (Harlan) and water, and grouped according to matched body weights (4 kg) into three different treatment groups (n=4). Twenty-four hours before the graded dextrose infusion, the monkeys were administered either saline or the peptides via a single subcutaneous injection. Monkeys from all test groups were fasted for 16 hours before initiation of the graded dextrose infusion. Thirty minutes before the dextrose infusion, the monkeys were sedated with Telazol (intramuscularly, 7 mg/kg), and an intravenous catheter for the dextrose infusion was placed in the cephalic vein. Baseline blood samples were obtained from the femoral artery or vein 20, 10, and 0 min before the infusion of dextrose. At 0 min, an infusion of a dextrose solution at 5 mg/kg per minute was initiated, and blood was collected after 10 and 20 min. Just after the 20-min blood sample was collected, the dextrose infusion rate was increased to 10 mg/kg per minute, and blood samples were again collected after 10 and 20 min of infusion at that rate. Just after the 40-min blood sample was collected, the dextrose infusion rate was increased to 25 mg/kg per minute, and blood was collected after 10 and 20 min of infusion at that rate.

Figure 35A:
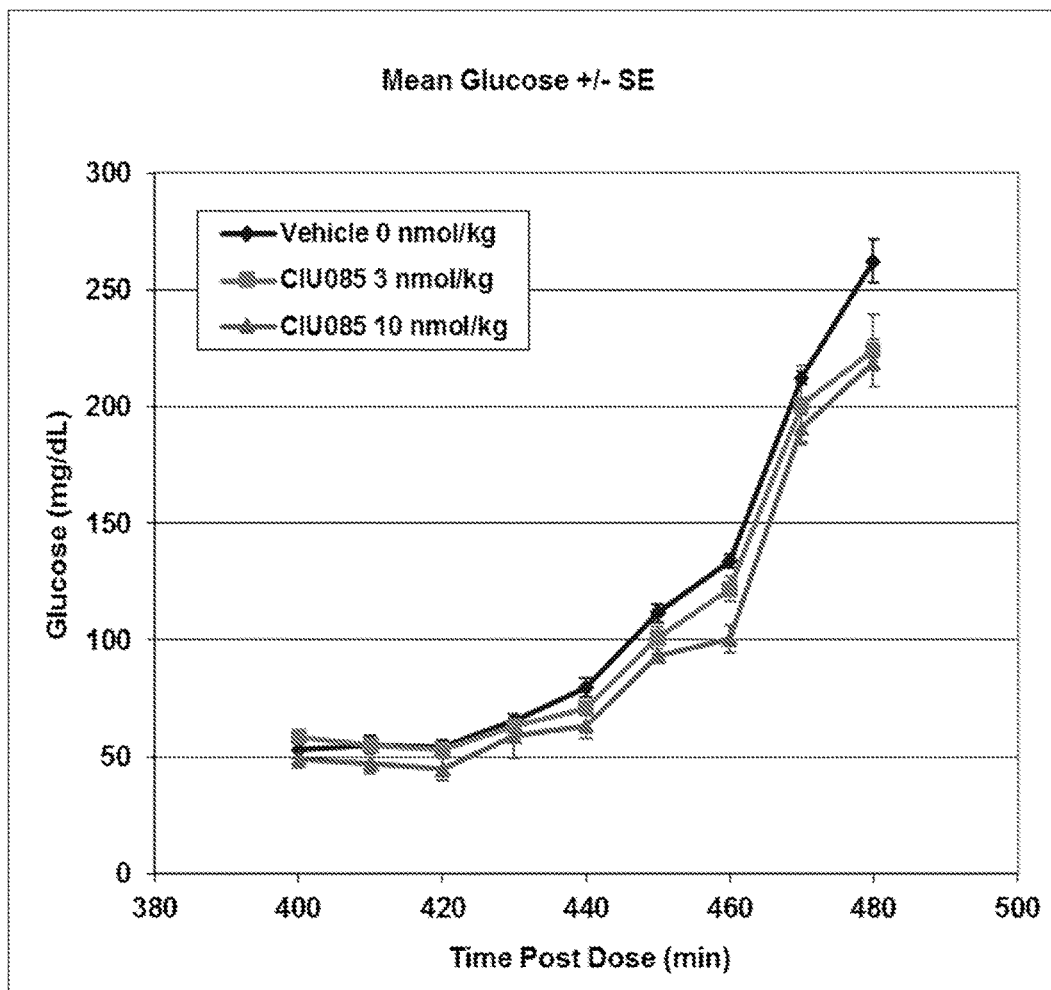
FIGS. 35A and 35B are graphs measuring the blood glucose levels (FIG. 35A) and peptide C levels (FIG. 35B) in monkeys infused with glucose (to drive glucose levels up—GLP-1 and GIP responses only seen with elevated blood glucose) and administered CIU 085 subcutaneously at one of two doses (3 nmol/kg or 10 nmol/kg). CIU 085 which lacks insulin activity is able to induce C-peptide production (a marker for insulin production), thus demonstrating these compounds have incretin activity in monkeys.
Figure 35B:
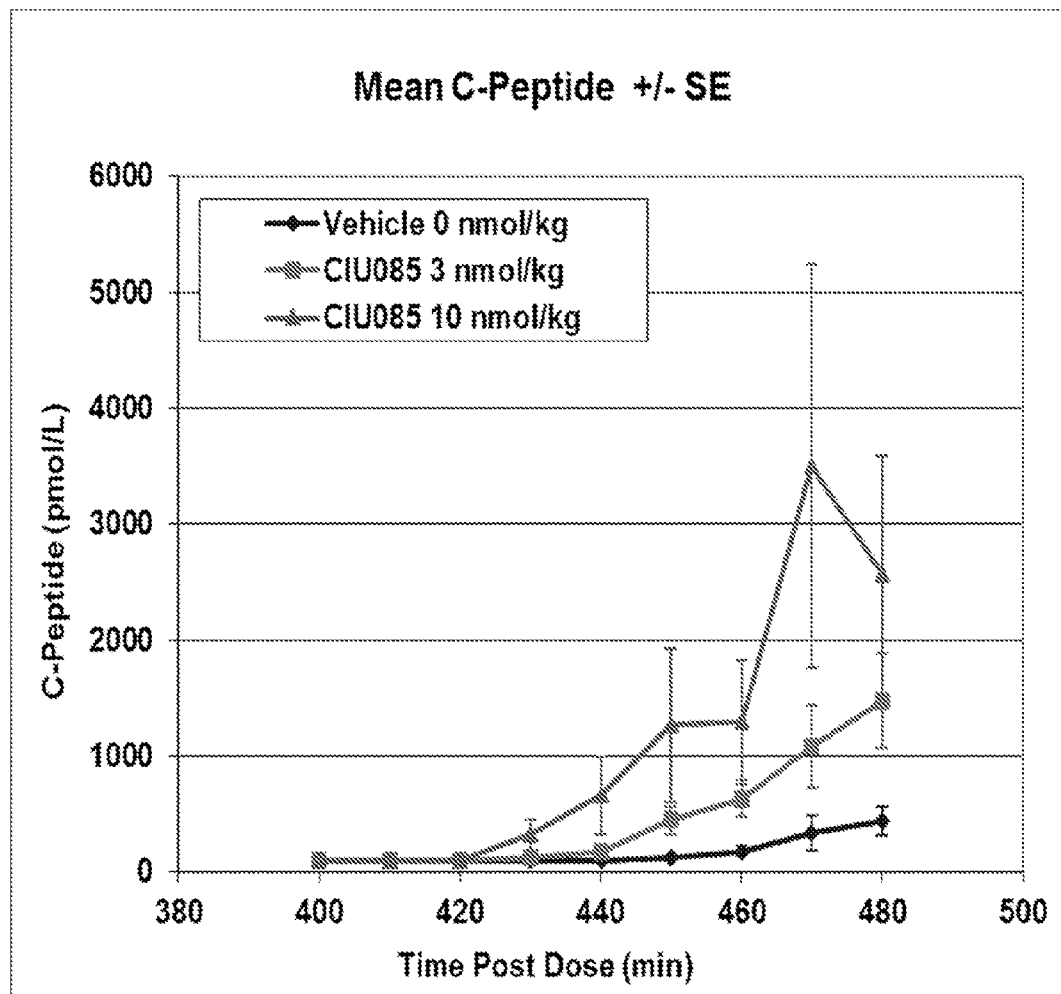

Blood was collected in EDTA- and aprotinin-containing (250 kallikrein inhibitory units/ml) tubes. Glucose, insulin, and C-peptide were measured in plasma, which was prepared from each of the blood samples described above. Plasma samples were provided to Millipore to measure compound concentration. Insulin was measured by a paramagnetic particle, chemiluminescent immunoassay (Beckman Coulter Access 2), and glucose was measured by the hexokinase method (Roche Hitachi 917). The results of the experiment are provide in FIGS. 35A and 35B.

Procedure for Pig Studies

Figure 36:
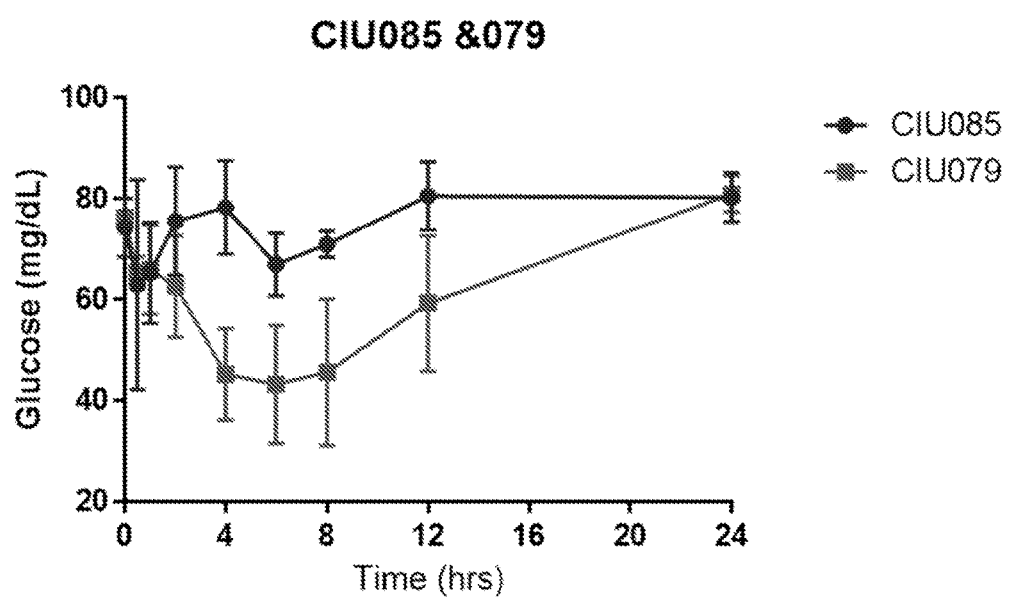
FIG. 36 is a graph measuring the blood glucose levels in normal mini-pigs administered CIU 085 or CIU079 subcutaneously at a dose of 3 nmol/kg. This demonstrates that CIU-079 has insulin activity and lowers blood glucose, whereas CIU-085's ability to lower blood glucose is minimal even though it has GLP-1 and GIP activity.
Figure 37:
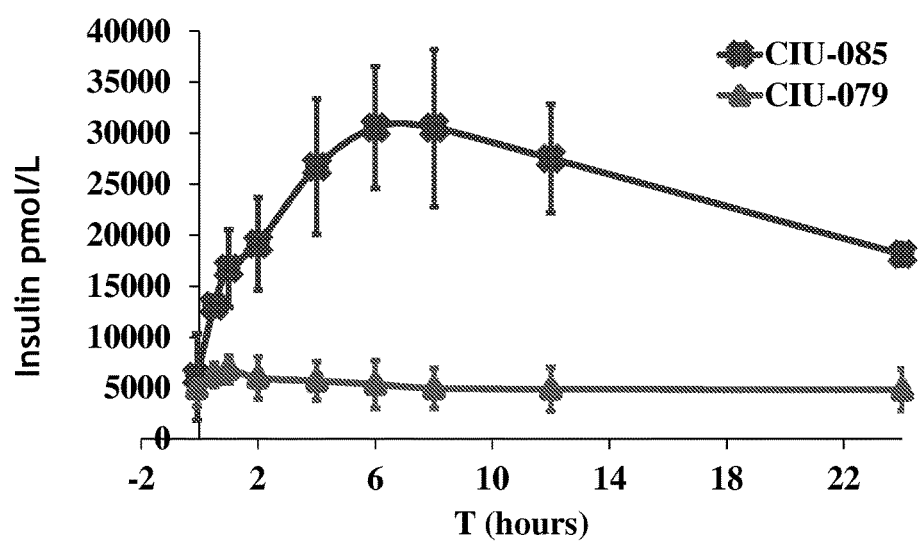
FIG. 37 is a graph measuring the blood insulin levels in normal mini-pigs administered CIU 085 or CIU079 subcutaneously at a dose of 3 nmol/kg. This demonstrates that CIU-079 gets cleared as it is active at the insulin receptor; whereas CIU-085 which is not active at the insulin receptor is not cleared and continues to induce insulin production.

Animals were fasted for 12 hours prior to study. After accessing ports, blood glucose was measured with a hand-held glucometer. Using the same glucometer for all animals, two readings were taken to make sure values were consistent. Animals were randomized by glucose level to achieve a balanced distribution across groups. At each specified time-point, ~3 mL of whole blood was collected into blood collection tubes containing K3EDTA as the anticoagulant and 100 µg/mL Aprotinin and was placed on ice bath immediately following collection. Whole blood samples were centrifuged within 30 minutes of collection and at least 0.5 mL of plasma was obtained and stored for future analysis including insulin PK (ELISA-based assay). A small portion of the 3 mL whole blood sample (prior to placement into the blood collection tubes) was used to check blood glucose using a hand-held glucometer immediately after collection. The results of the experiment are provide in FIGS. 36 and 37.

SEQUENCE LISTING (2044 sequences)

SEQ ID NO: 1 - protein, 21 aa, Homo sapiens
GIVEQCCTSICSLYQLENYCN

SEQ ID NO: 2 - protein, 30 aa, Homo sapiens
FVNQHLCGSHLVEALYLVCGERGFFYTPKT

SEQ ID NO: 3 - protein, 21 aa, Artificial Sequence
  Analog of the insulin A chain
  MISC_FEATURE (8)..(8): Xaa at position 8 is threonine or histidine
  MISC_FEATURE (21)..(21): Xaa at position 21 is asparagine, glycine, alanine, glutamine, glutamate, threonine, or serine
GIVEQCCXSICSLYQLENYCX

SEQ ID NO: 4 - protein, 21 aa, Artificial Sequence
  Analog of the insulin B chain
  MISC_FEATURE (1)..(1): Xaa at position 1 is histidine or threonine
  MISC_FEATURE (5)..(5): Xaa at position 5 is alanine, glycine or serine
  MISC_FEATURE (6)..(6): Xaa at position 6 is histidine, aspartic acid, glutamic acid, homocysteic acid or cysteic acid
XLCGXXLVEALYLVCGERGFF

SEQ ID NO: 5 - protein, 30 aa, Homo sapiens
FVNQHLCGSHLVEALYLVCGERGFFYTDKT

SEQ ID NO: 6 - protein, 30 aa, Homo sapiens
FVKQHLCGSHLVEALYLVCGERGFFYTEKT

SEQ ID NO: 7 - protein, 21 aa, Homo sapiens
HLCGSHLVEALYLVCGERGFF

SEQ ID NO: 8 - protein, 4 aa, Homo sapiens
FVKQ

SEQ ID NO: 9 - protein, 30 aa, Homo sapiens
FVNQHLCGSHLVEALYLVCGERGFFYTKPT

SEQ ID NO: 10 - protein, 30 aa, Artificial Sequence
  Analog of insulin B chain
  MISC_FEATURE (1)..(1): Xaa at position 1 is phenylalanine or desamino-phenylalanine.
  MISC_FEATURE (5)..(5): Xaa at position 5 is histidine and threonine
  MISC_FEATURE (9)..(9): Xaa at position 9 is alanine, glycine or serine
  MISC_FEATURE (10)..(10): Xaa at position 10 is histidine, aspartic acid, glutamic acid, homocysteic acid or cysteic acid
XVNQXLCGXXLVEALYLVCGERGFFYTPKT

SEQ ID NO: 11 - protein, 4 aa, Homo sapiens
PGPE

SEQ ID NO: 12 - protein, 4 aa, Homo sapiens
FVNQ

SEQ ID NO: 13 - protein, 30 aa, Artificial Sequence
  Analog of insulin B chain
  MISC_FEATURE (1)..(1): Xaa at position 1 is phenylalanine or desamino-phenylalanine.
  MISC_FEATURE (5)..(5): Xaa at position 5 is histidine and threonine
  MISC_FEATURE (9)..(9): Xaa at position 9 is alanine, glycine or serine
  MISC_FEATURE (10)..(10): Xaa at position 10 is histidine, aspartic acid, glutamic acid, homocysteic acid or cysteic acid
XVNQXLCGXXLVEALYLVCGERGFFYTKPT

SEQ ID NO: 14 - protein, 6 aa, Homo sapiens
AYRPSE

SEQ ID NO: 15 - protein, 21 aa, Homo sapiens
  MISC_FEATURE (21)..(21): Xaa at position 21 is histidine, tyrosine or phenylalanine
HLCGSHLVEALYLVCGERGFX

SEQ ID NO: 16 - protein, 21 aa, Homo sapiens
  MISC_FEATURE (1)..(1): Xaa at position 1 is histidine or threonine
  MISC_FEATURE (5)..(5): Xaa at position 5 is alanine, glycine or serine
  MISC_FEATURE (6)..(6): Xaa at position 6 is histidine, aspartic acid, glutamic acid, homocysteic acid orcysteic acid
  MISC_FEATURE (21)..(21): Xaa at position 21 is histidine, tyrosine or phenylalanine
XLCGXXLVEALYLVCGERGFX

SEQ ID NO: 17 - protein, 6 aa, Artificial Sequence
  peptide linker
  MISC_FEATURE (1)..(1): The Xaa at position 1 is histidine or a histidine analog
  MOD_RES (6)..(6): Amidation
XSRGTF

SEQ ID NO: 18 - protein, 8 aa, Artificial Sequence
  model synthetic peptide
  MISC_FEATURE (2)..(2): The Xaa at position 2 is sarcosine
  MOD_RES (8)..(8): AMIDATION
KXHSRGTF

SEQ ID NO: 19 - protein, 21 aa, Artificial Sequence
  Analog of the insulin A chain
  MISC_FEATURE (4)..(4): Xaa at position 5 is aspartic acid or glutamic acid
  MISC_FEATURE (5)..(5): Xaa at position 5 is glutamine or glutamic acid
  MISC_FEATURE (8)..(8): Xaa at position 8 is histidine, threonine or phenylalanine
  MISC_FEATURE (9)..(9): Xaa at position 9 is serine, arginine, ornithine, lysine or alanine
  MISC_FEATURE (10)..(10): Xaa at position 10 is isoleucine or serine
  MISC_FEATURE (12)..(12): Xaa at position 12 is aspartic acid or serine
  MISC_FEATURE (14)..(14): Xaa at position 14 is tyrosine, arginine, ornathine, lysine or alanine
  MISC_FEATURE (15)..(15): Xaa at position 15 is glutamine, glutamic acid, arginine, ornithine, alanine, lysine or leucine
  MISC_FEATURE (17)..(17): Xaa at position 17 is glutamine or glutamic acid
  MISC_FEATURE (18)..(18): Xaa at position 18 is methionine, asparagine, glutamine, glutamic acid, aspartic acid or threonine
  MISC_FEATURE (21)..(21): Xaa at position 21 is alanine, glycine, serine, valine, threonine, isoleucine, leucine, glutamine, glutamic acid, asparagine, aspartic acid, histidine, tryptophan, tyrosine, or methionine
GIVXXCCXXXCXLXXLXXYCX

SEQ ID NO: 20 - protein, 21 aa, Artificial Sequence
  Analog of the insulin B chain
  MISC_FEATURE (1)..(1): Xaa at position 1 is histidine or threonine
  MISC_FEATURE (5)..(5): Xaa at position 5 is alanine, glycine or serine
  MISC_FEATURE (6)..(6): Xaa at position 6 is histidine, aspartic acid, glutamic acid, homocysteic acid or cysteic acid
  MISC_FEATURE (9)..(9): Xaa at position 9 is aspartic acid, glutamine or glutamic acid
  MISC_FEATURE (10)..(10): Xaa at position 10 is alanine or threonine
  MISC_FEATURE (17)..(17): Xaa at position 12 is glutamic acid, aspartic acid or asparagine
  MISC_FEATURE (18)..(18): Xaa at position 18 is alanine, ornithine, lysine or arginine
  MISC_FEATURE (21)..(21): Xaa at position 21 is tyrosine or 4-amino-phenylalanine
XLCGXXLVXXLYLVCGXXGFX

SEQ ID NO: 21 - protein, 6 aa, Artificial Sequence
  glucagon analogue
  MOD_RES (1)..(1): Xaa at position 1 is d-histidine
  MOD_RES (2)..(2): Xaa at position 2 is d-threonine
  MOD_RES (3)..(3): Xaa at position 3 is d-arginine
  MOD_RES (5)..(5): Xaa at position 5 is d-threonine
  MOD_RES (6)..(6): Xaa at position 6 is d-phenylalanine
XXXGXX

SEQ ID NO: 22 - protein, 7 aa, Artificial Sequence
  peptide linker
GGGPGKR

SEQ ID NO: 23 - protein, 12 aa, Artificial Sequence
  peptide linker
GYGSSSRRAPQT

SEQ ID NO: 24 - protein, 7 aa, Artificial Sequence
  peptide linker
GGGGGKR

SEQ ID NO: 25 - protein, 7 aa, Artificial Sequence
  peptide linker
RRGGGGG

SEQ ID NO: 26 - protein, 9 aa, Artificial Sequence
  peptide linker
GGAPGDVKR

SEQ ID NO: 27 - protein, 9 aa, Artificial Sequence
  peptide linker
RRAPGDVGG

SEQ ID NO: 28 - protein, 9 aa, Artificial Sequence
  peptide linker
GGYPGDVKR

SEQ ID NO: 29 - protein, 9 aa, Artificial Sequence
  peptide linker
RRYPGDVGG

SEQ ID NO: 30 - protein, 9 aa, Artificial Sequence
  peptide linker
GGHPGDVKR

SEQ ID NO: 31 - protein, 9 aa, Artificial Sequence
  peptide linker
RRHPGDVGG

SEQ ID NO: 32 - protein, 7 aa, Artificial Sequence
  peptide linker
RRGPGGG

SEQ ID NO: 33 - protein, 51 aa, Artificial Sequence
  single chain human insulin analog
  MISC_FEATURE (49)..(49): Xaa at position 49 is 4-amino phenylalanine or 4-methoxy phenylalanine
FVNQHLCGSHLVEALYLVCGERGFFYTPKTGIVEQCCTSICSLYQLENXCN

SEQ ID NO: 34 - protein, 63 aa, Artificial Sequence
  single-chain human insulin analog
  MISC_FEATURE (61)..(61): Xaa at position 61 is 4-amino phenylalanine or 4-methoxy phenylalanine
FVNQHLCGSHLVEALYLVCGERGFFYTPKTQPLALEGSLQKRGIVEQCCTSICSLYQLENXCN

SEQ ID NO: 35 - protein, 7 aa, Artificial Sequence
  peptide linker
AGRGSGK

SEQ ID NO: 36 - protein, 7 aa, Artificial Sequence
  peptide linker
AGLGSGK

SEQ ID NO: 37 - protein, 7 aa, Artificial Sequence
  peptide linker
AGMGSGK

SEQ ID NO: 38 - protein, 7 aa, Artificial Sequence
  peptide linker
ASWGSGK

SEQ ID NO: 39 - protein, 7 aa, Artificial Sequence
  peptide linker
TGLGSGQ

SEQ ID NO: 40 - protein, 7 aa, Artificial Sequence
  peptide linker
TGLGRGK

SEQ ID NO: 41 - protein, 7 aa, Artificial Sequence
  peptide linker
TGLGSGK

SEQ ID NO: 42 - protein, 7 aa, Artificial Sequence
  peptide linker
HGLYSGK

SEQ ID NO: 43 - protein, 7 aa, Artificial Sequence
  peptide linker
KGLGSGQ

SEQ ID NO: 44 - protein, 7 aa, Artificial Sequence
  peptide linker
VGLMSGK

SEQ ID NO: 45 - protein, 7 aa, Artificial Sequence
  peptide linker
VGLSSGQ

SEQ ID NO: 46 - protein, 7 aa, Artificial Sequence
  peptide linker
VGLYSGK

SEQ ID NO: 47 - protein, 7 aa, Artificial Sequence
  peptide linker
VGLSSGK

SEQ ID NO: 48 - protein, 7 aa, Artificial Sequence
  peptide linker
VGMSSGK

SEQ ID NO: 49 - protein, 7 aa, Artificial Sequence
  peptide linker
VWSSSGK

SEQ ID NO: 50 - protein, 7 aa, Artificial Sequence
  peptide linker
VGSSSGK

SEQ ID NO: 51 - protein, 7 aa, Artificial Sequence
  peptide linker
VGMSSGK

SEQ ID NO: 52 - protein, 7 aa, Artificial Sequence
  peptide linker
TGLGSGR

SEQ ID NO: 53 - protein, 7 aa, Artificial Sequence
  peptide linker
TGLGKGQ

SEQ ID NO: 54 - protein, 7 aa, Artificial Sequence
  peptide linker
KGLSSGQ

SEQ ID NO: 55 - protein, 7 aa, Artificial Sequence
  peptide linker
VKLSSGQ

SEQ ID NO: 56 - protein, 7 aa, Artificial Sequence
  peptide linker
VKLSSGQ

SEQ ID NO: 57 - protein, 7 aa, Artificial Sequence
  peptide linker
TGLGKGQ

SEQ ID NO: 58 - protein, 7 aa, Artificial Sequence
  peptide linker
VGLSKGQ

SEQ ID NO: 59 - protein, 8 aa, Artificial Sequence
  glucagon analogue
  MOD_RES (1)..(1): Xaa at position 1 is d-lysine
  MOD_RES (2)..(2): Xaa at position 2 is d-sarcosine
  MOD_RES (3)..(3): Xaa at position 3 is d-histidine
  MOD_RES (4)..(4): Xaa at position 4 is d-threonine
  MOD_RES (5)..(5): Xaa at position 5 is d-arginine
  MOD_RES (7)..(7): Xaa at position 7 is d-threonine
  MOD_RES (8)..(8): d-phenylalanine
  MOD_RES (8)..(8): Xaa at position 8 is d-phenylalanine
XXXXXGXX

SEQ ID NO: 60 - protein, 8 aa, Homo sapiens
SRVSRRSR

SEQ ID NO: 61 - protein, 8 aa, Homo sapiens
GYGSSSRR

SEQ ID NO: 62 - protein, 8 aa, Homo sapiens
GSSSRRAP

SEQ ID NO: 63 - protein, 8 aa, Homo sapiens
  MISC_FEATURE (7)..(7): Xaa at position 7 is ornithine
GYGSSSXR

SEQ ID NO: 64 - protein, 12 aa, Homo sapiens
GAGSSSRRAPQT

SEQ ID NO: 65 - protein, 21 aa, Artificial Sequence
  Analog of the insulin B chain
  MISC_FEATURE (1)..(1): Xaa at position 1 is histidine or threonine
  MISC_FEATURE (6)..(6): Xaa at position 6 is histidine, aspartic acid, glutamic acid, homocysteic acid or cysteic acid
  MISC_FEATURE (18)..(18): Xaa at position 18 is alanine ornithine or arginine
XLCGAXLVDALYLVCGDXGFY

SEQ ID NO: 66 - protein, 8 aa, Homo sapiens
GYGSSSRR

SEQ ID NO: 67 - protein, 23 aa, Artificial Sequence
  Analog of the insulin B chain
  MISC_FEATURE (1)..(1): Xaa at position 1 is histidine or threonine
  MISC_FEATURE (5)..(5): Xaa at position 5 is alanine, glycine or serine
  MISC_FEATURE (6)..(6): Xaa at position 6 is histidine, aspartic acid, glutamic acid, homocysteic acid or cysteic acid
  MISC_FEATURE (9)..(9): Xaa at position 9 is histidine, aspartic acid or glutamic acid
  MISC_FEATURE (10)..(10): Xaa at position 10 is alanine or threonin
  MISC_FEATURE (17)..(17): Xaa at position 17 is glutamic acid, aspartic acid or asparagine
  MISC_FEATURE (18)..(18): Xaa at position 18 is alanine ornithine, lysine or arginine
  MISC_FEATURE (21)..(21): Xaa at position 21 is tyrosine or phenylalanine
XLCGXXLVXXLYLVCGXXGFXYT

SEQ ID NO: 68 - protein, 21 aa, Homo sapiens
GIVDECCFRSCDLRRLEMYCA

SEQ ID NO: 69 - protein, 29 aa, Homo sapiens
GPETLCGAELVDALYLVCGDRGFYFNKPT

SEQ ID NO: 70 - protein, 21 aa, Homo sapiens
GIVEECCFRSCDLALLETYCA

SEQ ID NO: 71 - protein, 32 aa, Homo sapiens
AYRPSETLCGGELVDTLQFVCGDRGFYFSRPA

SEQ ID NO: 72 - protein, 29 aa, Artificial Sequence
  glucagon analogue
  MISC_FEATURE (1)..(1): Xaa at position 1 = His, D-histidine, desaminohistidine, hydroxyl-histidine, acetyl-histidine, homo-histidine or alpha, alpha-dimethyl imidiazole acetic acid (DMIA), N-methyl histidine, alpha-methyl histidine, or imidazole acetic acid
  MISC_FEATURE (2)..(2): Xaa at position 2 = Ser, D-serine, Ala, D-alanine, Val, glycine, n-methyl serine, aminoisobutyric acid (AIB) or N-methyl alanine
  MISC_FEATURE (3)..(3): Xaa at position 3 is Gln, Glu, Orn or  Nle
  MISC_FEATURE (10)..(10): Xaa at position 10 = Tyr, Val or Trp
  MISC_FEATURE (12)..(12): Xaa at position 12 = Ser, Lys or Arg
  MISC_FEATURE (15)..(15): Xaa at position 15 = Asp, Glu, cysteic acid, homoglutamic acid and homocysteic acid
  MISC_FEATURE (16)..(16): Xaa at position 16 = Ser, Gly, Glu, Gln, homoglutamic acid or homocysteic acid
  MISC_FEATURE (17)..(17): Xaa at position 17 = Arg, Gln, Lys, Cys, Orn, homocycstein or acetyl phenylalanine
  MISC_FEATURE (18)..(18): Xaa at position 18 = Arg, Ala,Lys, Cys, Orn, homocycstein or acetyl phenylalanine
  MISC_FEATURE (20)..(20): Xaa at position 20 = Gln, Lys, arginine, ornithine or citrulline
  MISC_FEATURE (21)..(21): Xaa at position 21 = Gln, Glu, Asp, Lys, Cys, Orn, homocycstein or acetyl phenyalanine
  MISC_FEATURE (23)..(23): Xaa at position 23 is Val or Ile
  MISC_FEATURE (24)..(24): Xaa at position 24 = Ala, Gln, Glu, Lys, Cys, Orn, homocycstein or acetyl phenyalanine
  MISC_FEATURE (27)..(27): Xaa at position 27 = Met, Leu, Val or Nle
  MISC_FEATURE (28)..(28): Xaa at position 28 = Asn, Lys or Asp
  MISC_FEATURE (29)..(29): Xaa at position 29 is Thr, Gly, Lys, Cys, Orn, homocycstein or acetyl phenyalanine
XXXGTFTSDXSXYLXXXXAXXFXXWLXXX

SEQ ID NO: 73 - protein, 21 aa, Artificial Sequence
  Analog of Insulin A chain
  MISC_FEATURE (8)..(8): Xaa at position 8 is  threonine or histidine
  MISC_FEATURE (9)..(9): Xaa at position 9 is  valine or tyrosine
  misc_feature (19)..(19): Xaa can be any naturally occurring amino acid
  MISC_FEATURE (21)..(21): Xaa at position 21 is asparagine or glycine
GIVEQCCXXICSLYQLENXCX

SEQ ID NO: 74 - protein, 21 aa, Artificial Sequence
  Analog of the insulin A chain
  MISC_FEATURE (8)..(8): Xaa at position 8 is histidine or phenylalnine
  MISC_FEATURE (9)..(9): Xaa at position 9 is arginine, lysine, ornithine or alanine
  MISC_FEATURE (19)..(19): Xaa at position19 is tyrosine, 4-methoxy phenylalanine  or 4-amino-phenylalanine
  MISC_FEATURE (21)..(21): Xaa at position 21 is alanine, glycine or asparagine
GIVDECCXXSCDLRRLEMXCX

SEQ ID NO: 75 - protein, 21 aa, Artificial Sequence
  Analog of the insulin B chain
  MISC_FEATURE (1)..(1): Xaa at position 1 is histidine or threonine
  MISC_FEATURE (6)..(6): Xaa at position 6 is histidine, aspartic acid, glutamic acid, homocysteic acid or cysteic acid
  MISC_FEATURE (18)..(18): Xaa at position 18 is alanine, ornithine, lysine or arginine
  misc_feature (21)..(21): Xaa can be any naturally occurring amino acid
XLCGAXLVDALYLVCGDXGFX

SEQ ID NO: 76 - protein, 8 aa, Artificial Sequence
  Analog of IGF-1 C peptide
  MISC_FEATURE (7)..(8): The Xaas at positions 7 and 8 are independently arginine, lysine or ornithine
GAGSSSXX

SEQ ID NO: 77 - protein, 12 aa, Artificial Sequence
  Analog of IGF-1 C peptide
  MISC_FEATURE (7)..(8): The Xaas at positions 7 and 8 are independently arginine, lysine or ornithine
GYGSSSXXAPQT

SEQ ID NO: 78 - protein, 10 aa, Artificial Sequence
  peptide fragment representing the carboxy terminal 10 amino acids of Exendin-4
GPSSGAPPPS

SEQ ID NO: 79 - protein, 10 aa, Artificial Sequence
  peptide fragment representing the carboxy terminal 10 amino acids of Exendin-4
  MOD_RES (10)..(10): AMIDATION
GPSSGAPPPS

SEQ ID NO: 80 - protein, 11 aa, Artificial Sequence
  peptide fragment representing the carboxy terminal 10 amino acids of Exendin-4
  MISC_FEATURE (11)..(11): pegylated
GPSSGAPPPSC

SEQ ID NO: 81 - protein, 29 aa, Homo sapiens
  MISC_FEATURE (15)..(15): Xaa at position 15 = Asp, Glu, homoglutamic acid, cysteic acid or homocysteic acid
  MISC_FEATURE (16)..(16): Xaa at position 16 = Ser, Glu, Gln, homoglutamic acid or homocysteic acid
  MISC_FEATURE (20)..(20): Xaa at position 20 = Gln or Lys
  MISC_FEATURE (24)..(24): Xaa at position 24 = Gln or Glu
  MISC_FEATURE (28)..(28): Xaa at position 28 = Asn, Lys or an acidic amino acid
  MISC_FEATURE (29)..(29): Xaa at position 29 = Thr, Gly or an acidic amino acid
HSQGTFTSDYSKYLXXRRAXDFVXWLMXX

SEQ ID NO: 82 - protein, 29 aa, Homo sapiens
  MISC_FEATURE (15)..(15): Xaa at position 15 = Asp, Glu, cysteic acid, homoglutamic acid or homocysteic acid
  MISC_FEATURE (16)..(16): Xaa at position 16 = Ser, Glu, Gln, homoglutamic acid or homocysteic acid
  MISC_FEATURE (20)..(20): Xaa at position 20 = Gln or Lys
  MISC_FEATURE (24)..(24): Xaa at position 24 = Gln or Glu
  MISC_FEATURE (28)..(28): Xaa at position 28 = Asn, Asp or Lys
  MISC_FEATURE (29)..(29): Xaa at position 29 is Thr or Gly
HSQGTFTSDYSKYLDXRRAXDFVXWLMXX

SEQ ID NO: 83 - protein, 29 aa, Artificial Sequence
  glucagon analogue
  MISC_FEATURE (3)..(3): Xaa at position 3= Glu, Orn or Nle
  MISC_FEATURE (15)..(15): Xaa at position 15 = Asp, Glu, homoglutamic acid, cysteic acid or homocysteic acid
  MISC_FEATURE (16)..(16): Xaa at position 16 = Ser, Glu, Gln, homoglutamic acid or homocysteic acid
  MISC_FEATURE (20)..(20): Xaa at position 20 = Gln or Lys
  MISC_FEATURE (24)..(24): Xaa at position 24 = Gln or Glu
  MISC_FEATURE (28)..(28): Xaa at position 28 = Asn, Lys or an acidic amino acid
  MISC_FEATURE (29)..(29): Xaa at position 29 = Thr or an acidic amino acid
HSXGTFTSDYSKYLXXRRAXDFVXWLMXX

SEQ ID NO: 84 - protein, 29 aa, Artificial Sequence
  Glucagon analogue
  MISC_FEATURE (15)..(15): Xaa at position 15 is Glu or Asp
  MISC_FEATURE (28)..(28): Xaa at position 28 is Glu or Asp
  MOD_RES (29)..(29): AMIDATION
HSQGTFTSDYSKYLXERRAQDFVQWLMXT

SEQ ID NO: 85 - protein, 29 aa, Artificial Sequence
  glucagon analogue
  MISC_FEATURE (12)..(16): lactam ring formed between side chain of Lys 12 and Glu 16
  MISC_FEATURE (15)..(15): Xaa at position 15 is Glu or Asp
  MISC_FEATURE (28)..(28): Xaa at position 28 is Glu or Asp
  MOD_RES (29)..(29): AMIDATION
HSQGTFTSDYSKYLXERRAQDFVQWLMXT

SEQ ID NO: 86 - protein, 29 aa, Artificial Sequence
  glucagon analogue
  MISC_FEATURE (15)..(15): Xaa at position 15 is Glu or Asp
  MISC_FEATURE (16)..(20): lactam ring formed between side chain of Glu 16 and Lys 20
  MISC_FEATURE (28)..(28): Xaa at position 28 is Glu or Asp
  MOD_RES (29)..(29): AMIDATION
HSQGTFTSDYSKYLXERRAKDFVQWLMXT

SEQ ID NO: 87 - protein, 29 aa, Artificial Sequence
  glucagon analogue
  MISC_FEATURE (15)..(15): Xaa at position 15 is Glu or Asp
  MISC_FEATURE (20)..(24): lactam ring formed between side chain of Lys 20 and Glu 24
  MISC_FEATURE (28)..(28): Xaa at position 28 is Glu or Asp
  MOD_RES (29)..(29): AMIDATION
HSQGTFTSDYSKYLXSRRAKDFVEWLMXT

SEQ ID NO: 88 - protein, 29 aa, Artificial Sequence
  glucagon analogue
  MISC_FEATURE (15)..(15): Xaa at position 15 is Glu or Asp
  MISC_FEATURE (24)..(28): lactam ring formed between side chain of Glu 24 and Lys 28
  MISC_FEATURE (29)..(29): Xaa at position 29 is Glu or Thr
  MOD_RES (29)..(29): AMIDATION
HSQGTFTSDYSKYLXSRRAQDFVEWLMKX

SEQ ID NO: 89 - protein, 29 aa, Homo sapiens
  MISC_FEATURE (27)..(27): Xaa at position 27 is Met, Leu or Nle
HSQGTFTSDYSKYLDSRRAQDFVQWLXNT

SEQ ID NO: 90 - protein, 29 aa, Artificial Sequence
  glucagon analogue
  MISC_FEATURE (16)..(16): Xaa is Glu, Gln, homoglutamic acid or homocysteic acid
  MISC_FEATURE (17)..(17): Xaa is Arg, Cys, Orn, homocysteine or acetyl phenylalanine
  MISC_FEATURE (27)..(27): Xaa at position 27 is Met, Leu or Nle
HSQGTFTSDYSKYLDXXRAQDFVQWLXNT

SEQ ID NO: 91 - protein, 29 aa, Artificial Sequence
  Glucagon analogue
  MISC_FEATURE (16)..(16): Xaa is Glu, Gln, homoglutamic acid or homocysteic acid
  MISC_FEATURE (21)..(21): Xaa is Asp, Cys, Orn, homocysteine or acetyl phenyalanine
  MISC_FEATURE (27)..(27): Xaa at position 27 is Met, Leu or Nle
HSQGTFTSDYSKYLDXRRAQXFVQWLXNT

SEQ ID NO: 92 - protein, 29 aa, Artificial Sequence
  glucagon analog
  MISC_FEATURE (16)..(16): Xaa is Glu, Gln, homoglutamic acid or homocysteic acid
  MISC_FEATURE (24)..(24): Xaa is Gln, Cys, Orn, homocysteine or acetyl phenylalanine
  MISC_FEATURE (27)..(27): Xaa at postion 27 is Met, Leu or Nle
HSQGTFTSDYSKYLDXRRAQDFVXWLXNT

SEQ ID NO: 93 - protein, 29 aa, Artificial Sequence
  Glucagon analogue
  MISC_FEATURE (16)..(16): Xaa is Glu, Gln, homoglutamic acid or homocysteic acid
  MISC_FEATURE (21)..(21): Xaa is Asp, Cys, Orn, homocysteine or acetyl phenyalanine
  MISC_FEATURE (24)..(24): Xaa is Gln, Cys, Orn, homocysteine or acetyl phenyalanine
  MISC_FEATURE (27)..(27): Xaa at position 27 is Met, Leu or Nle
HSQGTFTSDYSKYLDXRRAQXFVXWLXNT

SEQ ID NO: 94 - protein, 29 aa, Artificial Sequence
  Glucagon analogue
  MISC_FEATURE (21)..(21): Xaa is Asp, Cys, Orn, homocysteine or acetyl phenyalanine
  MISC_FEATURE (27)..(27): Xaa is Met, Leu or Nle
HSQGTFTSDYSKYLDERRAQXFVQWLXNT

SEQ ID NO: 95 - protein, 29 aa, Artificial Sequence
  Glucagon analogue
  MISC_FEATURE (24)..(24): Xaa at position 24 is Gln, Cys, Orn, homocysteine or acetyl phenylalanine
  MISC_FEATURE (27)..(27): Xaa at position 27 is Met, Leu or Nle
HSQGTFTSDYSKYLDERRAQDFVXWLXNT

SEQ ID NO: 96 - protein, 29 aa, Artificial Sequence
  Glucagon analogue
  MISC_FEATURE (16)..(16): Xaa at position 16 is Glu, Gln, homoglutamic acid or homocysteic acid
HSQGTFTSDYSKYLDXRRAQDFVQWLMNT

SEQ ID NO: 97 - protein, 29 aa, Artificial Sequence
  Glucagon analogue
  MISC_FEATURE (27)..(27): Xaa at position 27 = Met, Leu or Nle
HSQGTFTSDYSKYLDERRAQDFVQWLXNT

SEQ ID NO: 98 - protein, 29 aa, Artificial Sequence
  Glucagon analogue
HSQGTFTSDYSKYLDERRAQDFVQWLMNT

SEQ ID NO: 99 - protein, 29 aa, Artificial Sequence
  Glucagon analogue
  MOD_RES (29)..(29): AMIDATION
HSQGTFTSDYSKYLDERRAQDFVQWLMNT

SEQ ID NO: 100 - protein, 29 aa, Artificial Sequence
  glucagon analogue
  MISC_FEATURE (12)..(16): lactam ring formed between side chain of Lys 12 and Glu 16
HSQGTFTSDYSKYLDERRAQDFVQWLMNT

SEQ ID NO: 101 - protein, 29 aa, Artificial Sequence
  glucagon analogue
  MISC_FEATURE (16)..(20): lactam ring formed between side chain of Glu 16 and Lys 20
HSQGTFTSDYSKYLDERRAKDFVQWLMNT

SEQ ID NO: 102 - protein, 29 aa, Artificial Sequence
  glucagon analogue
  MISC_FEATURE (20)..(24): lactam ring formed between side chain of Lys 20 and Glu 24
HSQGTFTSDYSKYLDSRRAKDFVEWLMNT

SEQ ID NO: 103 - protein, 29 aa, Homo sapiens
  MISC_FEATURE (24)..(28): lactam ring formed between side chain of Glu 24 and Lys 28
HSQGTFTSDYSKYLDSRRAQDFVEWLMKT

SEQ ID NO: 104 - protein, 29 aa, Homo sapiens
  MISC_FEATURE (12)..(16): lactam ring formed between side chain of Lys 12 and Glu 16
  MISC_FEATURE (20)..(24): lactam ring formed between side chain of Lys 20 and Glu 24
HSQGTFTSDYSKYLDERRAKDFVEWLMNT

SEQ ID NO: 105 - protein, 29 aa, Homo sapiens
  MISC_FEATURE (16)..(20): lactam ring formed between side chain of Lys 12 and Glu 16
  MISC_FEATURE (24)..(28): lactam ring formed between side chain of Glu 24 and Lys 28
HSQGTFTSDYSKYLDERRADDFVEWLMKT

SEQ ID NO: 106 - protein, 29 aa, Homo sapiens
  MISC_FEATURE (16)..(20): lactam ring formed between side chain of Glu 16 and Lys 20
  MISC_FEATURE (24)..(28): lactam ring formed between side chain of Glu 24 and Lys 28
HSQGTFTSDYSKYLDERRAKDFVEWLMKT

SEQ ID NO: 107 - protein, 30 aa, Artificial Sequence
  Glucagon analogue
  MISC_FEATURE (30)..(30): Xaa = any amino acid
  MOD_RES (30)..(30): AMIDATION
HSQGTFTSDYSKYLDERRAQDFVQWLMNTX

SEQ ID NO: 108 - protein, 29 aa, Homo sapiens
  MISC_FEATURE (16)..(16): Xaa at position 16 = Ser, Glu, Gln, homoglutamic acid or homocysteic acid
  MISC_FEATURE (20)..(20): Xaa at position 20 = glutamine, lysine, arginine, ornithine or citrulline
  MISC_FEATURE (24)..(24): Xaa at position 24 = Gln or Glu
  MISC_FEATURE (28)..(28): Xaa at position 28 = Asn, Asp or Lys
  MISC_FEATURE (29)..(29): Xaa at position 29 = Thr or Gly
HSQGTFTSDYSKYLDXRRAXDFVXWLMXX

SEQ ID NO: 109 - protein, 29 aa, Artificial Sequence
  glucagon analogue
  MISC_FEATURE (12)..(16): lactam ring formed between side chain of Lys 12 and Glu 16
  MISC_FEATURE (28)..(28): Xaa at position 28 is Asp or Asn
  MISC_FEATURE (29)..(29): Xaa at position 29 is Thr or Gly
HSQGTFTSDYSKYLDERRAQDFVQWLMXX

SEQ ID NO: 110 - protein, 29 aa, Artificial Sequence
  glucagon analogue
  MISC_FEATURE (16)..(20): lactam ring formed between side chain of Glu 16 and Lys 20
  MISC_FEATURE (28)..(28): Xaa at position 28 is Asp or Asn
  MISC_FEATURE (29)..(29): Xaa at position 29 is Thr or Gly
HSQGTFTSDYSKYLDERRAKDFVQWLMXX

SEQ ID NO: 111 - protein, 29 aa, Artificial Sequence
  glucagon analogue
  MISC_FEATURE (20)..(24): lactam ring formed between side chain of Lys 20 and Glu 24
  MISC_FEATURE (28)..(28): Xaa at position 28 is Asp or Asn
  MISC_FEATURE (29)..(29): Xaa at position 29 is Thr or Gly
HSQGTFTSDYSKYLDSRRAKDFVEWLMXX

SEQ ID NO: 112 - protein, 29 aa, Artificial Sequence
  glucagon analogue
  MISC_FEATURE (24)..(28): lactam ring formed between side chain of Glu 24 and Lys 28
  MISC_FEATURE (29)..(29): Xaa at position 29 is Thr or Gly
HSQGTFTSDYSKYLDSRRAQDFVEWLMKX

SEQ ID NO: 113 - protein, 29 aa, Homo sapiens
  MISC_FEATURE (16)..(16): Xaa at position 16 = Ser, Glu, Gln, homoglutamic acid or homocysteic acid
  MISC_FEATURE (20)..(20): Xaa at position 20 = glutamine, lysine, arginine, ornithine or citrulline
  MISC_FEATURE (24)..(24): Xaa at position 24 = Gln or Glu
  MISC_FEATURE (28)..(28): Xaa at position 28 = Asn, Asp or Lys
  MISC_FEATURE (29)..(29): Xaa at position 29 = Thr or Gly
HSQGTFTSDYSKYLDXRRAXDFVXWLMXX

SEQ ID NO: 114 - protein, 29 aa, Homo sapiens
HSQGTFTSDYSKYLDERRAKDFVQWLMNT

SEQ ID NO: 115 - protein, 29 aa, Artificial Sequence
  glucagon analogue
HSQGTFTSDYSKYLDSRRAKDFVEWLMNT

SEQ ID NO: 116 - protein, 29 aa, Artificial Sequence
  glucagon analogue
HSQGTFTSDYSKYLDSRRAQDFVEWLMKT

SEQ ID NO: 117 - protein, 8 aa, Artificial Sequence
  peptide fragment representing the carboxy terminal 8 amino acids of oxyntomodulin
KRNRNNIA

SEQ ID NO: 118 - protein, 4 aa, Artificial Sequence
  peptide fragment representing the amino 4 amino acids of oxyntomodulin carboxy terminus of SEQ ID NO: 27
KRNR

SEQ ID NO: 119 - protein, 29 aa, homo sapiens
HSQGTFTSDYSKYLDERRAKDFVQWLMNT

SEQ ID NO: 120 - protein, 29 aa, Artificial Sequence
  glucagon analogue
  MISC_FEATURE (1)..(1): Xaa at position 1 = His, D-histidine, desaminohistidine, hydroxyl-histidine, acetyl-histidine, homo-histidine or alpha, alpha-dimethyl imidiazole acetic acid (DMIA), N-methyl histidine, alpha-methyl histidine, or imidazole acetic acid
  MISC_FEATURE (2)..(2): Xaa at position 2 = Ser, D-serine, Ala, D-alanine, Val, glycine, n-methyl serine, aminoisobutyric acid (AIB) or N-methyl alanine
  MISC_FEATURE (3)..(3): Xaa at position 3 is Gln, Glu, Orn or  Nle
  MISC_FEATURE (15)..(15): Xaa at position 15 = Asp, Glu, cysteic acid, homoglutamic acid and homocysteic acid
  MISC_FEATURE (16)..(16): Xaa at position 16 = Ser, Glu, Gln, homoglutamic acid or homocysteic acid
  MISC_FEATURE (20)..(20): Xaa at position 20 = Gln, Lys, arginine, ornithine or citrulline
  MISC_FEATURE (21)..(21): Xaa at position 21 = Gln, Glu, Asp, Lys, Cys, Orn, homocycstein or acetyl phenyalanine
  MISC_FEATURE (23)..(23): Xaa at position 23 is Val or Ile
  MISC_FEATURE (24)..(24): Xaa at position 24 = Ala, Gln, Glu, Lys, Cys, Orn, homocycstein or acetyl phenyalanine
  MISC_FEATURE (27)..(27): Xaa at position 27 = Met, Leu or Nle
  MISC_FEATURE (28)..(28): Xaa at position 28 = Asn, Lys or Asp
  MISC_FEATURE (29)..(29): Xaa at position 29 is Thr or Gly, Lys, Cys, Orn, homocycstein or acetyl phenyalanine
XXXGTFTSDYSKYLXXRRAXXFXXWLXXX

SEQ ID NO: 121 - protein, 38 aa, Artificial Sequence
  glucagon analogue
  MISC_FEATURE (15)..(15): Xaa at position 15 = Asp, Glu, homoglutamic acid, cysteic acid or homocysteic acid
  MISC_FEATURE (16)..(16): Xaa at position 16 = Ser, Glu, Gln, homoglutamic acid or homocysteic acid
  MISC_FEATURE (20)..(20): Xaa at position 20 = Gln or Lys
  MISC_FEATURE (24)..(24): Xaa at position 24 = Gln or Glu
  MISC_FEATURE (28)..(28): Xaa at position 28 = Asn, Lys or Asp
HSQGTFTSDYSKYLXXRRAXDFVXWLMXGGPSSGPPPS

SEQ ID NO: 122 - protein, 29 aa, Artificial Sequence
  glucagon analogue
  MISC_FEATURE (16)..(16): Xaa at position 16 = Ser, Glu, Gln, homoglutamic acid or homocysteic acid
  MISC_FEATURE (20)..(20): Xaa at position 20 = Gln or Lys
  MISC_FEATURE (21)..(21): Xaa at position 21 = Asp, Lys, Cys, Orn, homocycstein or acetyl phenyalanine
  MISC_FEATURE (24)..(24): Xaa at position 24 = Gln, Lys, Cys, Orn, homocycstein or acetyl phenyalanine
  MISC_FEATURE (27)..(27): Xaa at position 27 = Met, Leu or Nle
HSQGTFTSDYSKYLDXRRAXXFVXWLXNT

SEQ ID NO: 123 - protein, 29 aa, Artificial Sequence
  glucagon analogue
  MISC_FEATURE (15)..(15): Xaa at position 15 = Asp, Glu, homoglutamic acid, cysteic acid or homocysteic acid
  MISC_FEATURE (16)..(16): Xaa at position 16 = Ser, Glu, Gln, homoglutamic acid or homocysteic acid
  MISC_FEATURE (20)..(20): Xaa at position 20 = Gln, Lys, Arg, Orn, or citrulline
  MISC_FEATURE (21)..(21): Xaa at position 21 = Asp, Glu, homoglutamic acid, or homocysteic acid
  MISC_FEATURE (24)..(24): Xaa at position 24 = Gln or Glu
  MISC_FEATURE (28)..(28): Xaa at position 28 = Asn, Lys or an acidic amino acid
  MISC_FEATURE (29)..(29): Xaa at position 29 = Thr, Gly or an acidic amino acid
HSQGTFTSDYSKYLXXRRAXXFVXWLMXX

SEQ ID NO: 124 - protein, 29 aa, Homo sapiens
HSQGTFTSDYSKYLDERRAKDFVQWLMNT

SEQ ID NO: 125 - protein, 29 aa, Artificial Sequence
  glucagon analogue
HSQGTFTSDYSKYLDSRRAKDFVEWLMNT

SEQ ID NO: 126 - protein, 29 aa, Artificial Sequence
  glucagon analogue
HSQGTFTSDYSKYLDSRRAQDFVEWLMKT

SEQ ID NO: 127 - protein, 29 aa, Artificial Sequence
  Glucagon analogue
  MISC_FEATURE (2)..(2): Xaa is d-serine, alanine, glycine, n-methyl serine and aminoisobutyric acid
  MOD_RES (29)..(29): AMIDATION
HXQGTFTSDYSKYLDERRAQDFVQWLMNT

SEQ ID NO: 128 - protein, 29 aa, Artificial Sequence
  Glucagon analogue
  MISC_FEATURE (2)..(2): Xaa is aminoisobutyric acid
  MOD_RES (29)..(29): AMIDATION
HXQGTFTSDYSKYLDERRAQDFVQWLMNT

SEQ ID NO: 129 - protein, 39 aa, Artificial Sequence
  Glucagon analogue
  MISC_FEATURE (27)..(27): Xaa is Met, Leu or Nle
HSQGTFTSDYSKYLDERRAQDFVQWLXNTGPSSGAPPPS

SEQ ID NO: 130 - protein, 37 aa, Artificial Sequence
  Glucagon analogue
  MISC_FEATURE (27)..(27): Xaa is Met, Leu or Nle
HSQGTFTSDYSKYLDERRAQDFVQWLXNTKRNRNNIA

SEQ ID NO: 131 - protein, 33 aa, Artificial Sequence
  Glucagon analogue
  MISC_FEATURE (27)..(27): Xaa is Met, Leu or Nle
HSQGTFTSDYSKYLDERRAQDFVQWLXNTKRNR

SEQ ID NO: 132 - protein, 88 aa, Artificial Sequence
  Insulin conjugate
HAEGTFTSDVSSYLEEQAAREFIAWLVRGRGGPEHLCGAHLVDALYLVCGDRGFYFNDRGAGSSSRRGIVDECCHRSCDLRRLENYCN

SEQ ID NO: 133 - protein, 88 aa, Artificial Sequence
  Insulin conjugate
HAEGTFTSDVSSYLEEQAAREFIAWLVRGRGGPEHLCGAHLVDALYLVCGDRGFYFNDRGAGSSSRRGIVDECCHRSCDLRRLENACN

SEQ ID NO: 134 - protein, 88 aa, Artificial Sequence
  Insulin conjugate
HAEGTFTSDVSSYLEEQAAREAIAWLVRGRGGPEHLCGAHLVDALYLVCGDRGFYFNDRGAGSSSRRGIVDECCHRSCDLRRLENYCN

SEQ ID NO: 135 - protein, 86 aa, Artificial Sequence
  Insulin conjugate
HSQGTFTSDYSKYLDSRRAQDFVQWLMNTGPEHLCGAHLVDALYLVCGDRGFYFNDRGAGSSSRRGIVDECCHRSCDLRRLENYCN

SEQ ID NO: 136 - protein, 86 aa, Artificial Sequence
  Insulin conjugate
HSQGTFTSDYSKYLDSRRAQDFVQWLMNTGPEHLCGAHLVDALYLVCGDRGFYFNDRGAGSSSRRGIVDECCHRSCDLRRLENACN

SEQ ID NO: 137 - protein, 86 aa, Artificial Sequence
  Insulin conjugate
HSEGTFTSDYSKYLDSRRAQDFVQWLMNTGPEHLCGAHLVDALYLVCGDRGFYFNDRGAGSSSRRGIVDECCHRSCDLRRLENYCN

SEQ ID NO: 138 - protein, 86 aa, Artificial Sequence
  Insulin conjugate
HSQGTFTSDYSKYLDERRAQDFVQWLMNTGPEHLCGAHLVDALYLVCGDRGFYFNDRGAGSSSRRGIVDECCHRSCDLRRLENYCN

SEQ ID NO: 139 - protein, 90 aa, Artificial Sequence
  Conjugate of GLP-1 and insulin
HAEGTFTSDVSSYLEEQAAREFIAWLVRGRGFVNQHLCGSHLVEALYLVCGERGFFYTPKTGAGSSSRRGIVEQCCTSICSLYQLENYCN

SEQ ID NO: 140 - protein, 88 aa, Artificial Sequence
  Conjugate of glucagon and insulin
HSQGTFTSDYSKYLDSRRAQDFVQWLMNTFVNQHLCGSHLVEALYLVCGERGFFYTPKTGAGSSSRRGIVEQCCTSICSLYQLENYCN

SEQ ID NO: 141 - protein, 35 aa, Homo sapiens
RREAEDLQVGQVELGGGPGAGSLQPLALEGSLQKR

SEQ ID NO: 142 - protein, 23 aa, Artificial Sequence
  Analog of the insulin B chain
  MISC_FEATURE (1)..(1): Xaa at position 1 is histidine or threonine
  MISC_FEATURE (5)..(5): Xaa at position 5 is alanine, glycine or serine
  MISC_FEATURE (6)..(6): Xaa at position 6 is histidine, aspartic acid, glutamic acid, homocysteic acid or cysteic acid
  MISC_FEATURE (9)..(9): Xaa at position 9 is aspartic acid, glutamine or glutamic acid
  MISC_FEATURE (10)..(10): Xaa at position 10 is alanine or threonine
  MISC_FEATURE (17)..(17): Xaa at position 12 is glutamic acid, aspartic acid or asparagine
  MISC_FEATURE (18)..(18): Xaa at position 18 is alanine, ornithine, lysine or arginine
  MISC_FEATURE (21)..(21): Xaa at position 21 is tyrosine or 4-amino-phenylalanine
XLCGXXLVXXLYLVCGXXGFXYT

SEQ ID NO: 143 - protein, 59 aa, Artificial Sequence
  Single chain insulin analog
FVNQHLCGSHLVEALYLVCGERGFFYTPKTGAGSSSRRGIVEQCCTSICSLYQLENYCN

SEQ ID NO: 144 - protein, 57 aa, Artificial Sequence
  Single chain insulin analog
  MISC_FEATURE (4)..(4): Xaa at position 4 is histidine or threonine
  MISC_FEATURE (9)..(9): Xaa at position 9 is ihistidine, aspartic acid, glutamic acid, homocysteic acid or cysteic acid
  MISC_FEATURE (21)..(21): Xaa at position 21 is alanine ornithine or arginine
  MISC_FEATURE (27)..(27): Xaa at position 21 is lysine or aspartic acid
  MISC_FEATURE (28)..(28): Xaa at position 21 is proline, ornithine or arginine
  MISC_FEATURE (44)..(44): Xaa at position 21 is phenylalanine or histidine
GPEXLCGAXLVDALYLVCGDXGFYFNXXGAGSSSRRGIVDECCXRSCDLRRLENYCN

SEQ ID NO: 145 - protein, 57 aa, Artificial Sequence
  Single chain insulin analog
GPEHLCGAHLVDALYLVCGDRGFYFNDRGAGSSSRRGIVDECCHRSCDLRRLENYCN

SEQ ID NO: 146 - protein, 29 aa, Artificial Sequence
  glucagon analog
  MISC_FEATURE: c-term amidation
  MISC_FEATURE (12)..(16): Lactam ring between side chains at positions 12 and 16
HSEGTFTSDYSKYLDERAAQDFVQWLMNT

SEQ ID NO: 147 - protein, 29 aa, Artificial Sequence
  glucagon analog
  MISC_FEATURE: c-term amidation
  MISC_FEATURE (12)..(16): Lactam ring between side chains at positions 12 and 16
HSEGTFTSDYSKYLDERAAKDFVQWLMNT

SEQ ID NO: 148 - protein, 29 aa, Artificial Sequence
  glucagon analog
  MISC_FEATURE: c-term amidation
  MISC_FEATURE (16)..(20): Lactam ring between side chains at positions 16 and 20
HSEGTFTSDYSKYLDKRAAEDFVQWLMNT

SEQ ID NO: 149 - protein, 29 aa, Artificial Sequence
  glucagon analog
  MISC_FEATURE: c-term amidation
HSEGTFTSDYSKYLDEQAAKEFIAWLMNT

SEQ ID NO: 150 - protein, 29 aa, Artificial Sequence
  glucagon analog
  MISC_FEATURE: c-term amidation
  MISC_FEATURE (12)..(16): Lactam ring between side chains at positions 12 and 16
HSEGTFTSDYSKYLDEQAAKEFIAWLMNT

SEQ ID NO: 151 - protein, 29 aa, Artificial Sequence
  glucagon analog
  MISC_FEATURE: c-term amidation
  MISC_FEATURE (16)..(20): Lactam ring between side chains at positions 16 and 20
HSEGTFTSDYSKYLDEQAAKEFIAWLMNT

SEQ ID NO: 152 - protein, 29 aa, Artificial Sequence
  glucagon analog
  MISC_FEATURE: c-term amidation
HSEGTFTSDYSKYLDEQAAKEFIAWLVKG

SEQ ID NO: 153 - protein, 29 aa, Artificial Sequence
  glucagon analog
  MISC_FEATURE: c-term amidation
  MISC_FEATURE (12)..(16): Lactam ring between side chains at positions 12 and 16
HSEGTFTSDYSKYLDEQAAKEFIAWLVKG

SEQ ID NO: 154 - protein, 29 aa, Artificial Sequence
  glucagon analog
  MISC_FEATURE: c-term amidation
  MISC_FEATURE (16)..(20): Lactam ring between side chains at positions 16 and 20
HSEGTFTSDYSKYLDEQAAKEFIAWLVKG

SEQ ID NO: 155 - protein, 29 aa, Artificial Sequence
  glucagon analog
  MISC_FEATURE: c-term amidation
  MOD_RES (1)..(1): (Des-amino)His
XSEGTFTSDYSKYLDERRAQDFVQWLMNT

SEQ ID NO: 156 - protein, 29 aa, Artificial Sequence
  glucagon analog
  MISC_FEATURE: c-term amidation
  MOD_RES (1)..(1): (Des-amino)His
XSEGTFTSDYSKYLDERRAKDFVQWLMNT

SEQ ID NO: 157 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDERRAKDFVQWLMNT

SEQ ID NO: 158 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
XSEGTFTSDYSKYLDERRAQDFVQWLMNT

SEQ ID NO: 159 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
XSEGTFTSDYSKYLDERRAKDFVQWLMNT

SEQ ID NO: 160 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDKRRAEDFVQWLMNT

SEQ ID NO: 161 - protein, 29 aa, Artificial Sequence
  glucagon analog
  MISC_FEATURE: c-term amidation
  MOD_RES (1)..(1): (Des-amino)His
XSEGTFTSDYSKYLDERAAKDFVQWLMNT

SEQ ID NO: 162 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDERAAKDFVQWLMNT

SEQ ID NO: 163 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
XSEGTFTSDYSKYLDERAAQDFVQWLMNT

SEQ ID NO: 164 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
XSEGTFTSDYSKYLDERAAKDFVQWLMNT

SEQ ID NO: 165 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDKRAAEDFVQWLMNT

SEQ ID NO: 166 - protein, 29 aa, Artificial Sequence
  glucagon analog
  MISC_FEATURE: c-term amidation
  MOD_RES (1)..(1): (Des-amino)His
XSEGTFTSDYSKYLDEQAAKEFIAWLMNT

SEQ ID NO: 167 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
XSEGTFTSDYSKYLDEQAAKEFIAWLMNT

SEQ ID NO: 168 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDEQAAKEFIAWLMNT

SEQ ID NO: 169 - protein, 29 aa, Artificial Sequence
  glucagon analog
  MISC_FEATURE: c-term amidation
  MOD_RES (1)..(1): (Des-amino)His
XSEGTFTSDYSKYLDEQAAKEFIAWLVKG

SEQ ID NO: 170 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
XSEGTFTSDYSKYLDEQAAKEFIAWLVKG

SEQ ID NO: 171 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDEQAAKEFIAWLVKG

SEQ ID NO: 172 - protein, 29 aa, Artificial Sequence
  glucagon analog
  MISC_FEATURE: c-term amidation
  MOD_RES (2)..(2): Aminoisobutyric acid
HXEGTFTSDYSKYLDERRAQDFVQWLMNT

SEQ ID NO: 173 - protein, 29 aa, Artificial Sequence
  glucagon analog
  MISC_FEATURE: c-term amidation
  MOD_RES (2)..(2): Aminoisobutyric acid
HXEGTFTSDYSKYLDERRAKDFVQWLMNT

SEQ ID NO: 174 - protein, 29 aa, Artificial Sequence
  glucagon analog
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDERRAKDFVQWLMNT

SEQ ID NO: 175 - protein, 29 aa, Artificial Sequence
  glucagon analog
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDERRAQDFVQWLMNT

SEQ ID NO: 176 - protein, 29 aa, Artificial Sequence
  glucagon analog
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDERRAKDFVQWLMNT

SEQ ID NO: 177 - protein, 29 aa, Artificial Sequence
  glucagon analog
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDKRRAEDFVQWLMNT

SEQ ID NO: 178 - protein, 29 aa, Artificial Sequence
  glucagon analog
  MISC_FEATURE: c-term amidation
  MOD_RES (2)..(2): Aminoisobutyric acid
HXEGTFTSDYSKYLDERAAKDFVQWLMNT

SEQ ID NO: 179 - protein, 29 aa, Artificial Sequence
  glucagon analog
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDERAAKDFVQWLMNT

SEQ ID NO: 180 - protein, 29 aa, Artificial Sequence
  glucagon analog
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDERAAQDFVQWLMNT

SEQ ID NO: 181 - protein, 29 aa, Artificial Sequence
  glucagon analog
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDERAAKDFVQWLMNT

SEQ ID NO: 182 - protein, 29 aa, Artificial Sequence
  glucagon analog
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDKRAAEDFVQWLMNT

SEQ ID NO: 183 - protein, 29 aa, Artificial Sequence
  glucagon analog
  MISC_FEATURE: c-term amidation
  MOD_RES (2)..(2): Aminoisobutyric acid
HXEGTFTSDYSKYLDEQAAKEFIAWLMNT

SEQ ID NO: 184 - protein, 29 aa, Artificial Sequence
  glucagon analog
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDEQAAKEFIAWLMNT

SEQ ID NO: 185 - protein, 29 aa, Artificial Sequence
  glucagon analog
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDEQAAKEFIAWLMNT

SEQ ID NO: 186 - protein, 29 aa, Artificial Sequence
  glucagon analog
  MISC_FEATURE: c-term amidation
  MOD_RES (2)..(2): Aminoisobutyric acid
HXEGTFTSDYSKYLDEQAAKEFIAWLVKG

SEQ ID NO: 187 - protein, 29 aa, Artificial Sequence
  glucagon analog
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDEQAAKEFIAWLVKG

SEQ ID NO: 188 - protein, 29 aa, Artificial Sequence
  glucagon analog
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDEQAAKEFIAWLVKG

SEQ ID NO: 189 - protein, 29 aa, Artificial Sequence
  glucagon analog
  MISC_FEATURE: c-term amidation
  MOD_RES (2)..(2): D-Ala
HXEGTFTSDYSKYLDERRAQDFVQWLMNT

SEQ ID NO: 190 - protein, 29 aa, Artificial Sequence
  glucagon analog
  MISC_FEATURE: c-term amidation
  MOD_RES (2)..(2): D-Ala
HXEGTFTSDYSKYLDERRAKDFVQWLMNT

SEQ ID NO: 191 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDERRAKDFVQWLMNT

SEQ ID NO: 192 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDERRAQDFVQWLMNT

SEQ ID NO: 193 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDERRAKDFVQWLMNT

SEQ ID NO: 194 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDKRRAEDFVQWLMNT

SEQ ID NO: 195 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDERAAKDFVQWLMNT

SEQ ID NO: 196 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDERAAKDFVQWLMNT

SEQ ID NO: 197 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDERAAQDFVQWLMNT

SEQ ID NO: 198 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDERAAKDFVQWLMNT

SEQ ID NO: 199 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDKRAAEDFVQWLMNT

SEQ ID NO: 200 - protein, 29 aa, Artificial Sequence
  glucagon analog
  MISC_FEATURE: c-term amidation
  MOD_RES (2)..(2): D-Ala
HXEGTFTSDYSKYLDEQAAKEFIAWLMNT

SEQ ID NO: 201 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDEQAAKEFIAWLMNT

SEQ ID NO: 202 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDEQAAKEFIAWLMNT

SEQ ID NO: 203 - protein, 29 aa, Artificial Sequence
  glucagon analog
  MISC_FEATURE: c-term amidation
  MOD_RES (2)..(2): D-Ala
HXEGTFTSDYSKYLDEQAAKEFIAWLVKG

SEQ ID NO: 204 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDEQAAKEFIAWLVKG

SEQ ID NO: 205 - protein, 29 aa, Artificial Sequence
  glucagon analog
  MISC_FEATURE: Lactam ring between side chains at positions 16 and 20
  MOD_RES (2)..(2): D-Ala
  MISC_FEATURE (16)..(20): c-term amidation
HXEGTFTSDYSKYLDEQAAKEFIAWLVKG

SEQ ID NO: 206 - protein, 29 aa, Artificial Sequence
  glucagon analog
  MISC_FEATURE: c-term amidation
  MOD_RES (24)..(24): Cys-PEG
HSQGTFTSDYSKYLDERRAQDFVCWLMNT

SEQ ID NO: 207 - protein, 29 aa, Artificial Sequence
  glucagon analog
  MISC_FEATURE: c-term amidation
  MOD_RES (24)..(24): Cys-PEG
HSQGTFTSDYSKYLDERRAKDFVCWLMNT

SEQ ID NO: 208 - protein, 29 aa, Artificial Sequence
  glucagon analog
  MISC_FEATURE: c-term amidation
  MISC_FEATURE (16)..(20): Lactam ring between side chains at positions 16 and 20
  MOD_RES (24)..(24): Cys-PEG
HSQGTFTSDYSKYLDERRAKDFVCWLMNT

SEQ ID NO: 209 - protein, 29 aa, Artificial Sequence
  glucagon analog
  MISC_FEATURE: c-term amidation
  MISC_FEATURE (12)..(16): Lactam ring between side chains at positions 12 and 16
  MOD_RES (24)..(24): Cys-PEG
HSQGTFTSDYSKYLDERRAQDFVCWLMNT

SEQ ID NO: 210 - protein, 29 aa, Artificial Sequence
  glucagon analog
  MISC_FEATURE: c-term amidation
  MISC_FEATURE (12)..(16): Lactam ring between side chains at positions 12 and 16
  MOD_RES (24)..(24): Cys-PEG
HSQGTFTSDYSKYLDERRAKDFVCWLMNT

SEQ ID NO: 211 - protein, 29 aa, Artificial Sequence
  glucagon analog
  MISC_FEATURE: c-term amidation
  MISC_FEATURE (16)..(20): Lactam ring between side chains at positions 16 and 20
  MOD_RES (24)..(24): Cys-PEG
HSQGTFTSDYSKYLDKRRAEDFVCWLMNT

SEQ ID NO: 212 - protein, 29 aa, Artificial Sequence
  glucagon analog
  MISC_FEATURE: c-term amidation
  MISC_FEATURE (16)..(20): Lactam ring between side chains at positions 16 and 20
  MOD_RES (24)..(24): Cys-PEG
HSQGTFTSDYSKYLDERAAKDFVCWLMNT

SEQ ID NO: 213 - protein, 29 aa, Artificial Sequence
  glucagon analog
  MISC_FEATURE: c-term amidation
  MISC_FEATURE (16)..(20): Lactam ring between side chains at positions 16 and 20
  MOD_RES (24)..(24): Cys-PEG
HSQGTFTSDYSKYLDERAAKDFVCWLMNT

SEQ ID NO: 214 - protein, 29 aa, Artificial Sequence
  glucagon analog
  MISC_FEATURE: c-term amidation
  MISC_FEATURE (12)..(16): Lactam ring between side chains at positions 12 and 16
  MOD_RES (24)..(24): Cys-PEG
HSQGTFTSDYSKYLDERAAQDFVCWLMNT

SEQ ID NO: 215 - protein, 29 aa, Artificial Sequence
  glucagon analog
  MISC_FEATURE: c-term amidation
  MISC_FEATURE (12)..(16): Lactam ring between side chains at positions 12 and 16
  MOD_RES (24)..(24): Cys-PEG
HSQGTFTSDYSKYLDERAAKDFVCWLMNT

SEQ ID NO: 216 - protein, 29 aa, Artificial Sequence
  glucagon analog
  MISC_FEATURE: c-term amidation
  MISC_FEATURE (16)..(20): Lactam ring between side chains at positions 16 and 20
  MOD_RES (24)..(24): Cys-PEG
HSQGTFTSDYSKYLDKRAAEDFVCWLMNT

SEQ ID NO: 217 - protein, 29 aa, Artificial Sequence
  glucagon analog
  MISC_FEATURE: c-term amidation
  MOD_RES (24)..(24): Cys-PEG
HSQGTFTSDYSKYLDEQAAKEFICWLMNT

SEQ ID NO: 218 - protein, 29 aa, Artificial Sequence
  glucagon analog
  MISC_FEATURE: c-term amidation
  MISC_FEATURE (12)..(16): Lactam ring between side chains at positions 12 and 16
  MOD_RES (24)..(24): Cys-PEG
HSQGTFTSDYSKYLDEQAAKEFICWLMNT

SEQ ID NO: 219 - protein, 29 aa, Artificial Sequence
  glucagon analog
  MISC_FEATURE: c-term amidation
  MISC_FEATURE (16)..(20): Lactam ring between side chains at positions 16 and 20
  MOD_RES (24)..(24): Cys-PEG
HSQGTFTSDYSKYLDEQAAKEFICWLMNT

SEQ ID NO: 220 - protein, 29 aa, Artificial Sequence
  glucagon analog
  MISC_FEATURE: c-term amidation
  MOD_RES (24)..(24): Cys-PEG
HSQGTFTSDYSKYLDEQAAKEFICWLVKG

SEQ ID NO: 221 - protein, 29 aa, Artificial Sequence
  glucagon analog
  MISC_FEATURE: c-term amidation
  MISC_FEATURE (12)..(16): Lactam ring between side chains at positions 12 and 16
  MOD_RES (24)..(24): Cys-PEG
HSQGTFTSDYSKYLDEQAAKEFICWLVKG

SEQ ID NO: 222 - protein, 29 aa, Artificial Sequence
  glucagon analog
  MISC_FEATURE: c-term amidation
  MISC_FEATURE (16)..(20): Lactam ring between side chains at positions 16 and 20
  MOD_RES (24)..(24): Cys-PEG
HSQGTFTSDYSKYLDEQAAKEFICWLVKG

SEQ ID NO: 223 - protein, 29 aa, Artificial Sequence
  glucagon analog
  MISC_FEATURE: c-term amidation
  MOD_RES (1)..(1): (Des-amino)His
  MOD_RES (24)..(24): Cys-PEG
XSQGTFTSDYSKYLDERRAQDFVCWLMNT

SEQ ID NO: 224 - protein, 29 aa, Artificial Sequence
  glucagon analog
  MISC_FEATURE: c-term amidation
  MOD_RES (1)..(1): (Des-amino)His
  MOD_RES (24)..(24): Cys-PEG
XSQGTFTSDYSKYLDERRAKDFVCWLMNT

SEQ ID NO: 225 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSQGTFTSDYSKYLDERRAKDFVCWLMNT

SEQ ID NO: 226 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSQGTFTSDYSKYLDERRAQDFVCWLMNT

SEQ ID NO: 227 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSQGTFTSDYSKYLDERRAKDFVCWLMNT

SEQ ID NO: 228 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSQGTFTSDYSKYLDKRRAEDFVCWLMNT

SEQ ID NO: 229 - protein, 29 aa, Artificial Sequence
  glucagon analog
  MISC_FEATURE: c-term amidation
  MOD_RES (1)..(1): (Des-amino)His
  MOD_RES (24)..(24): Cys-PEG
XSQGTFTSDYSKYLDERAAKDFVCWLMNT

SEQ ID NO: 230 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSQGTFTSDYSKYLDERAAKDFVCWLMNT

SEQ ID NO: 231 - protein, 29 aa, Artificial Sequence
  glucagon analog
  MISC_FEATURE: c-term amidation; lactam ring between side chains at positions 12 and 16
  MOD_RES (1)..(1): (Des-amino)His
  MOD_RES (24)..(24): Cys-PEG
XSQGTFTSDYSKYLDERAAQDFVCWLMNT

SEQ ID NO: 232 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSQGTFTSDYSKYLDERAAKDFVCWLMNT

SEQ ID NO: 233 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSQGTFTSDYSKYLDKRAAEDFVCWLMNT

SEQ ID NO: 234 - protein, 29 aa, Artificial Sequence
  glucagon analog
  MISC_FEATURE: c-term amidation
  MOD_RES (1)..(1): (Des-amino)His
  MOD_RES (24)..(24): Cys-PEG
XSQGTFTSDYSKYLDEQAAKEFICWLMNT

SEQ ID NO: 235 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSQGTFTSDYSKYLDEQAAKEFICWLMNT

SEQ ID NO: 236 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSQGTFTSDYSKYLDEQAAKEFICWLMNT

SEQ ID NO: 237 - protein, 29 aa, Artificial Sequence
  glucagon analog
  MISC_FEATURE: c-term amidation
  MOD_RES (1)..(1): (Des-amino)His
  MOD_RES (24)..(24): Cys-PEG
XSQGTFTSDYSKYLDEQAAKEFICWLVKG

SEQ ID NO: 238 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSQGTFTSDYSKYLDEQAAKEFICWLVKG

SEQ ID NO: 239 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSQGTFTSDYSKYLDEQAAKEFICWLVKG

SEQ ID NO: 240 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERRAQDFVCWLMNT

SEQ ID NO: 241 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERRAKDFVCWLMNT

SEQ ID NO: 242 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXQGTFTSDYSKYLDERRAKDFVCWLMNT

SEQ ID NO: 243 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXQGTFTSDYSKYLDERRAQDFVCWLMNT

SEQ ID NO: 244 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXQGTFTSDYSKYLDERRAKDFVCWLMNT

SEQ ID NO: 245 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring side chains at positions 16 and 20
  MOD_RES (24)..(24): Cys-PEG
HXQGTFTSDYSKYLDKRRAEDFVCWLMNT

SEQ ID NO: 246 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERAAKDFVCWLMNT

SEQ ID NO: 247 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXQGTFTSDYSKYLDERAAKDFVCWLMNT

SEQ ID NO: 248 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXQGTFTSDYSKYLDERAAQDFVCWLMNT

SEQ ID NO: 249 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXQGTFTSDYSKYLDERAAKDFVCWLMNT

SEQ ID NO: 250 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXQGTFTSDYSKYLDKRAAEDFVCWLMNT

SEQ ID NO: 251 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDEQAAKEFICWLMNT

SEQ ID NO: 252 - protein, 29 aa, Artificial Sequence
  Synthetic peptide
  misc_feature (2)..(2): Xaa can be any naturally occurring amino acid
HXQGTFTSDYSKYLDEQAAKEFICWLMNT

SEQ ID NO: 253 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXQGTFTSDYSKYLDEQAAKEFICWLMNT

SEQ ID NO: 254 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDEQAAKEFICWLVKG

SEQ ID NO: 255 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXQGTFTSDYSKYLDEQAAKEFICWLVKG

SEQ ID NO: 256 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXQGTFTSDYSKYLDEQAAKEFICWLVKG

SEQ ID NO: 257 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXQGTFTSDYSKYLDERRAQDFVCWLMNT

SEQ ID NO: 258 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXQGTFTSDYSKYLDERRAKDFVCWLMNT

SEQ ID NO: 259 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
  MOD_RES (24)..(24): Cys-PEG
HXQGTFTSDYSKYLDERRAKDFVCWLMNT

SEQ ID NO: 260 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chrains at positions 12 and 16
  MOD_RES (24)..(24): Cys-PEG
HXQGTFTSDYSKYLDERRAQDFVCWLMNT

SEQ ID NO: 261 - protein, 29 aa, Artificial Sequence
  Synthetic peptide
  MISC_FEATURE: c-term amidation; lactam ring between side chains at positions 12 and 16
  MOD_RES (2)..(2): D-Ala
  MOD_RES (24)..(24): Cys-PEG
HXQGTFTSDYSKYLDERRAKDFVCWLMNT

SEQ ID NO: 262 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
  MOD_RES (24)..(24): Cys-PEG
HXQGTFTSDYSKYLDKRRAEDFVCWLMNT

SEQ ID NO: 263 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXQGTFTSDYSKYLDERAAKDFVCWLMNT

SEQ ID NO: 264 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
  MOD_RES (24)..(24): Cys-PEG
HXQGTFTSDYSKYLDERAAKDFVCWLMNT

SEQ ID NO: 265 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
  MOD_RES (24)..(24): Cys-PEG
HXQGTFTSDYSKYLDERAAQDFVCWLMNT

SEQ ID NO: 266 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring betwee side chains at positions 12 and 16
  MOD_RES (24)..(24): Cys-PEG
HXQGTFTSDYSKYLDERAAKDFVCWLMNT

SEQ ID NO: 267 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
  MOD_RES (24)..(24): Cys-PEG
HXQGTFTSDYSKYLDKRAAEDFVCWLMNT

SEQ ID NO: 268 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXQGTFTSDYSKYLDEQAAKEFICWLMNT

SEQ ID NO: 269 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring betwee side chains at positions 12 and 16
  MOD_RES (24)..(24): Cys-PEG
HXQGTFTSDYSKYLDEQAAKEFICWLMNT

SEQ ID NO: 270 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring betwee side chains at positions 16 and 20
  MOD_RES (24)..(24): Cys-PEG
HXQGTFTSDYSKYLDEQAAKEFICWLMNT

SEQ ID NO: 271 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXQGTFTSDYSKYLDEQAAKEFICWLVKG

SEQ ID NO: 272 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
  MOD_RES (24)..(24): Cys-PEG
HXQGTFTSDYSKYLDEQAAKEFICWLVKG

SEQ ID NO: 273 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
  MOD_RES (24)..(24): Cys-PEG
HXQGTFTSDYSKYLDEQAAKEFICWLVKG

SEQ ID NO: 274 - protein, 29 aa, Artificial Sequence
  Synthetic peptide
  MISC_FEATURE: c-term amidation
  MOD_RES (24)..(24): Cys-PEG
HSEGTFTSDYSKYLDERRAQDFVCWLMNT

SEQ ID NO: 275 - protein, 29 aa, Artificial Sequence
  Synthetic peptide
  MISC_FEATURE: c-term amidation
  MOD_RES (24)..(24): Cys-PEG
HSEGTFTSDYSKYLDERRAKDFVCWLMNT

SEQ ID NO: 276 - protein, 29 aa, Artificial Sequence
  Synthetic peptide
  MISC_FEATURE: c-term amidation
  MISC_FEATURE (16)..(20): Lactam ring between side chains at positions 16 and 20
  MOD_RES (24)..(24): Cys-PEG
HSEGTFTSDYSKYLDERRAKDFVCWLMNT

SEQ ID NO: 277 - protein, 29 aa, Artificial Sequence
  Synthetic peptide
  MISC_FEATURE: c-term amidation
  MISC_FEATURE (12)..(16): Lactam ring between side chains at positions 12 and 16
  MOD_RES (24)..(24): Cys-PEG
HSEGTFTSDYSKYLDERRAQDFVCWLMNT

SEQ ID NO: 278 - protein, 29 aa, Artificial Sequence
  Synthetic peptide
  MISC_FEATURE: c-term amidation
  MISC_FEATURE (12)..(16): Lactam ring between side chains at positions 12 and 16
  MOD_RES (24)..(24): Cys-PEG
HSEGTFTSDYSKYLDERRAKDFVCWLMNT

SEQ ID NO: 279 - protein, 29 aa, Artificial Sequence
  Synthetic peptide
  MISC_FEATURE: c-term amidation
  MISC_FEATURE (16)..(20): Lactam ring between side chains at positions 16 and 20
  MOD_RES (24)..(24): Cys-PEG
HSEGTFTSDYSKYLDKRRAEDFVCWLMNT

SEQ ID NO: 280 - protein, 29 aa, Artificial Sequence
  Synthetic peptide
  MISC_FEATURE: c-term amidation
  MOD_RES (24)..(24): Cys-PEG
HSEGTFTSDYSKYLDERAAKDFVCWLMNT

SEQ ID NO: 281 - protein, 29 aa, Artificial Sequence
  Synthetic peptide
  MISC_FEATURE: c-term amidation
  MISC_FEATURE (16)..(20): Lactam ring between side chains at positions 16 and 20
  MOD_RES (24)..(24): Cys-PEG
HSEGTFTSDYSKYLDERAAKDFVCWLMNT

SEQ ID NO: 282 - protein, 29 aa, Artificial Sequence
  Synthetic peptide
  MISC_FEATURE: c-term amidation
  MISC_FEATURE (12)..(16): Lactam ring between side chains at positions 12 and 16
  MOD_RES (24)..(24): Cys-PEG
HSEGTFTSDYSKYLDERAAQDFVCWLMNT

SEQ ID NO: 283 - protein, 29 aa, Artificial Sequence
  Synthetic peptide
  MISC_FEATURE: c-term amidation
  MISC_FEATURE (12)..(16): Lactam ring between side chains at positions 12 and 16
  MOD_RES (24)..(24): Cys-PEG
HSEGTFTSDYSKYLDERAAKDFVCWLMNT

SEQ ID NO: 284 - protein, 29 aa, Artificial Sequence
  Synthetic peptide
  MISC_FEATURE: c-term amidation
  MISC_FEATURE (16)..(20): Lactam ring between side chains at positions 16 and 20
  MOD_RES (24)..(24): Cys-PEG
HSEGTFTSDYSKYLDKRAAEDFVCWLMNT

SEQ ID NO: 285 - protein, 29 aa, Artificial Sequence
  Synthetic peptide
  MISC_FEATURE: c-term amidation
  MOD_RES (24)..(24): Cys-PEG
HSEGTFTSDYSKYLDEQAAKEFICWLMNT

SEQ ID NO: 286 - protein, 29 aa, Artificial Sequence
  Synthetic peptide
  MISC_FEATURE: c-term amidation
  MISC_FEATURE (12)..(16): Lactam ring between side chains at positions 12 and 16
  MOD_RES (24)..(24): Cys-PEG
HSEGTFTSDYSKYLDEQAAKEFICWLMNT

SEQ ID NO: 287 - protein, 29 aa, Artificial Sequence
  Synthetic peptide
  MISC_FEATURE: c-term amidation
  MISC_FEATURE (16)..(20): Lactam ring between side chain at positions 16 and 20
  MOD_RES (24)..(24): Cys-PEG
HSEGTFTSDYSKYLDEQAAKEFICWLMNT

SEQ ID NO: 288 - protein, 29 aa, Artificial Sequence
  Synthetic peptide
  MISC_FEATURE: c-term amidation
  MOD_RES (24)..(24): Cys-PEG
HSEGTFTSDYSKYLDEQAAKEFICWLVKG

SEQ ID NO: 289 - protein, 29 aa, Artificial Sequence
  Synthetic peptide
  MISC_FEATURE: c-term amidation
  MISC_FEATURE (12)..(16): Lactam ring between side chains at positions 12 and 16
  MOD_RES (24)..(24): Cys-PEG
HSEGTFTSDYSKYLDEQAAKEFICWLVKG

SEQ ID NO: 290 - protein, 29 aa, Artificial Sequence
  Synthetic peptide
  MISC_FEATURE: c-term amidation
  MISC_FEATURE (16)..(20): Lactam ring between side chains at positions 16 and 20
  MOD_RES (24)..(24): Cys-PEG
HSEGTFTSDYSKYLDEQAAKEFICWLVKG

SEQ ID NO: 291 - protein, 29 aa, Artificial Sequence
  Synthetic peptide
  MISC_FEATURE: c-term amidation
  MOD_RES (1)..(1): (Des-amino)His
  MOD_RES (24)..(24): Cys-PEG
XSEGTFTSDYSKYLDERRAQDFVCWLMNT

SEQ ID NO: 292 - protein, 29 aa, Artificial Sequence
  Synthetic peptide
  MISC_FEATURE: c-term amidation
  MOD_RES (1)..(1): (Des-amino)His
  MOD_RES (24)..(24): Cys-PEG
XSEGTFTSDYSKYLDERRAKDFVCWLMNT

SEQ ID NO: 293 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSEGTFTSDYSKYLDERRAKDFVCWLMNT

SEQ ID NO: 294 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSEGTFTSDYSKYLDERRAQDFVCWLMNT

SEQ ID NO: 295 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSEGTFTSDYSKYLDERRAKDFVCWLMNT

SEQ ID NO: 296 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSEGTFTSDYSKYLDKRRAEDFVCWLMNT

SEQ ID NO: 297 - protein, 29 aa, Artificial Sequence
  Synthetic peptide
  MISC_FEATURE: c-term amidation
  MOD_RES (1)..(1): (Des-amino)His
  MOD_RES (24)..(24): Cys-PEG
XSEGTFTSDYSKYLDERAAKDFVCWLMNT

SEQ ID NO: 298 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSEGTFTSDYSKYLDERAAKDFVCWLMNT

SEQ ID NO: 299 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSEGTFTSDYSKYLDERAAQDFVCWLMNT

SEQ ID NO: 300 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSEGTFTSDYSKYLDERAAKDFVCWLMNT

SEQ ID NO: 301 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSEGTFTSDYSKYLDKRAAEDFVCWLMNT

SEQ ID NO: 302 - protein, 29 aa, Artificial Sequencce
  Synthetic peptide
  MISC_FEATURE: c-term amidation
  MOD_RES (1)..(1): (Des-amino)His
  MOD_RES (24)..(24): Cys-PEG
XSEGTFTSDYSKYLDEQAAKGFICWLMNT

SEQ ID NO: 303 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSEGTFTSDYSKYLDEQAAKGFICWLMNT

SEQ ID NO: 304 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSEGTFTSDYSKYLDEQAAKGFICWLMNT

SEQ ID NO: 305 - protein, 29 aa, Artificial Sequencce
  Synthetic peptide
  MISC_FEATURE: c-term amidation
  MOD_RES (1)..(1): (des-amino)His
  MOD_RES (24)..(24): Cys-PEG
XSEGTFTSDYSKYLDEQAAKGFICWLVKG

SEQ ID NO: 306 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSEGTFTSDYSKYLDEQAAKGFICWLVKG

SEQ ID NO: 307 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSEGTFTSDYSKYLDEQAAKGFICWLVKG

SEQ ID NO: 308 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXEGTFTSDYSKYLDERRAQDFVCWLMNT

SEQ ID NO: 309 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXEGTFTSDYSKYLDERRAKDFVCWLMNT

SEQ ID NO: 310 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXEGTFTSDYSKYLDERRAKDFVCWLMNT

SEQ ID NO: 311 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chain at positions 12 and 16
  MOD_RES (24)..(24): Cys-PEG
HXEGTFTSDYSKYLDERRAQDFVCWLMNT

SEQ ID NO: 312 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXEGTFTSDYSKYLDERRAKDFVCWLMNT

SEQ ID NO: 313 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXEGTFTSDYSKYLDKRRAEDFVCWLMNT

SEQ ID NO: 314 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXEGTFTSDYSKYLDERAAKDFVCWLMNT

SEQ ID NO: 315 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between seide chains at positions 16 and 20
  MOD_RES (24)..(24): Cys-PEG
HXEGTFTSDYSKYLDERAAKDFVCWLMNT

SEQ ID NO: 316 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXEGTFTSDYSKYLDERAAQDFVCWLMNT

SEQ ID NO: 317 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 adn 16
  MOD_RES (24)..(24): Cys-PEG
HXEGTFTSDYSKYLDERAAKDFVCWLMNT

SEQ ID NO: 318 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXEGTFTSDYSKYLDKRAAEDFVCWLMNT

SEQ ID NO: 319 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXEGTFTSDYSKYLDEQAAKEFICWLMNT

SEQ ID NO: 320 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXEGTFTSDYSKYLDEQAAKEFICWLMNT

SEQ ID NO: 321 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at position 16 and 20
  MOD_RES (24)..(24): Cys-PEG
HXEGTFTSDYSKYLDEQAAKEFICWLMNT

SEQ ID NO: 322 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXEGTFTSDYSKYLDEQAAKEFICWLVKG

SEQ ID NO: 323 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXEGTFTSDYSKYLDEQAAKEFICWLVKG

SEQ ID NO: 324 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at position 16 and 20
  MOD_RES (24)..(24): Cys-PEG
HXEGTFTSDYSKYLDEQAAKEFICWLVKG

SEQ ID NO: 325 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXEGTFTSDYSKYLDERRAQDFVCWLMNT

SEQ ID NO: 326 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXEGTFTSDYSKYLDERRAKDFVCWLMNT

SEQ ID NO: 327 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
  MOD_RES (24)..(24): Cys-PEG
HXEGTFTSDYSKYLDERRAKDFVCWLMNT

SEQ ID NO: 328 - protein, 29 aa, Artificial Sequence
  Synthetic peptide
  MISC_FEATURE: c-term amidation
  MOD_RES (2)..(2): D-Ala
  MISC_FEATURE (12)..(16): Lactam between side chains at positions 12 and 16
  MOD_RES (24)..(24): Cys-PEG
HXEGTFTSDYSKYLDERRAQDFVCWLMNT

SEQ ID NO: 329 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
  MOD_RES (24)..(24): Cys-PEG
HXEGTFTSDYSKYLDERRAKDFVCWLMNT

SEQ ID NO: 330 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
  MOD_RES (24)..(24): Cys-PEG
HXEGTFTSDYSKYLDKRRAEDFVCWLMNT

SEQ ID NO: 331 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXEGTFTSDYSKYLDERAAKDFVCWLMNT

SEQ ID NO: 332 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
  MOD_RES (24)..(24): Cys-PEG
HXEGTFTSDYSKYLDERAAKDFVCWLMNT

SEQ ID NO: 333 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
  MOD_RES (24)..(24): Cys-PEG
HXEGTFTSDYSKYLDERAAQDFVCWLMNT

SEQ ID NO: 334 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
  MOD_RES (24)..(24): Cys-PEG
HXEGTFTSDYSKYLDERAAKDFVCWLMNT

SEQ ID NO: 335 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chainst at positions 16 and 20
  MOD_RES (24)..(24): Cys-PEG
HXEGTFTSDYSKYLDKRAAEDFVCWLMNT

SEQ ID NO: 336 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXEGTFTSDYSKYLDEQAAKEFICWLMNT

SEQ ID NO: 337 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
  MOD_RES (24)..(24): Cys-PEG
HXEGTFTSDYSKYLDEQAAKEFICWLMNT

SEQ ID NO: 338 - protein, 29 aa, Artificial Sequence
  Synthetic peptide
  MISC_FEATURE: c-term amidation
  MOD_RES (2)..(2): D-Ala
  MISC_FEATURE (16)..(20): Lactam right between side chains at positions 16 and 20
  MOD_RES (24)..(24): Cys-PEG
HXEGTFTSDYSKYLDEQAAKEFICWLMNT

SEQ ID NO: 339 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXEGTFTSDYSKYLDEQAAKEFICWLVKG

SEQ ID NO: 340 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
  MOD_RES (24)..(24): Cys-PEG
HXEGTFTSDYSKYLDEQAAKEFICWLVKG

SEQ ID NO: 341 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
  MOD_RES (24)..(24): Cys-PEG
HXEGTFTSDYSKYLDEQAAKEFICWLVKG

SEQ ID NO: 342 - protein, 29 aa, Artificial Sequence
  Synthetic peptide
  MISC_FEATURE: c-term amidation
  MOD_RES (16)..(16): Cys-PEG
HSQGTFTSDYSKYLDCRRAKDFVQWLMNT

SEQ ID NO: 343 - protein, 29 aa, Artificial Sequence
  Synthetic peptide
  MISC_FEATURE: c-term amidation
  MOD_RES (16)..(16): Cys-PEG
HSQGTFTSDYSKYLDCRAAKDFVQWLMNT

SEQ ID NO: 344 - protein, 29 aa, Artificial Sequence
  Synthetic peptide
  MISC_FEATURE: c-term amidation
  MOD_RES (16)..(16): Cys-PEG
HSQGTFTSDYSKYLDCQAAKEFIAWLMNT

SEQ ID NO: 345 - protein, 29 aa, Artificial Sequence
  Synthetic peptide
  MISC_FEATURE: c-term amidation
  MOD_RES (16)..(16): Cys-PEG
HSQGTFTSDYSKYLDCQAAKEFIAWLVKG

SEQ ID NO: 346 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSQGTFTSDYSKYLDCRRAKDFVQWLMNT

SEQ ID NO: 347 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSQGTFTSDYSKYLDCRAAKDFVQWLMNT

SEQ ID NO: 348 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSQGTFTSDYSKYLDCQAAKEFIAWLMNT

SEQ ID NO: 349 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSQGTFTSDYSKYLDCQAAKEFIAWLVKG

SEQ ID NO: 350 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSQGTFTSDYSKYLDCQAAKEFIAWLMNT

SEQ ID NO: 351 - protein, 29 aa, Artificial Sequence
  Synthetic peptide
  MISC_FEATURE: c-term amidation
  MOD_RES (2)..(2): Aminoisobutyric acid
  MOD_RES (16)..(16): Cys-PEG
HXQGTFTSDYSKYLDCRAAKDFVQWLMNT

SEQ ID NO: 352 - protein, 29 aa, Artificial Sequence
  Synthetic peptide
  MISC_FEATURE: c-term amidation
  MOD_RES (2)..(2): Aminoisobutyric acid
  MOD_RES (16)..(16): Cys-PEG
HXQGTFTSDYSKYLDCQAAKEFIAWLMNT

SEQ ID NO: 353 - protein, 29 aa, Artificial Sequence
  Synthetic peptide
  MISC_FEATURE: c-term amidation
  MOD_RES (2)..(2): Aminoisobutyric acid
  MOD_RES (16)..(16): Cys-PEG
HXQGTFTSDYSKYLDCQAAKEFIAWLVKG

SEQ ID NO: 354 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXQGTFTSDYSKYLDCRRAKDFVQWLMNT

SEQ ID NO: 355 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXQGTFTSDYSKYLDCRAAKDFVQWLMNT

SEQ ID NO: 356 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXQGTFTSDYSKYLDCQAAKEFIAWLMNT

SEQ ID NO: 357 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXQGTFTSDYSKYLDCQAAKEFIAWLVKG

SEQ ID NO: 358 - protein, 29 aa, Artificial Sequence
  Synthetic peptide
  MISC_FEATURE: c-term amidation
  MOD_RES (16)..(16): Cys-PEG
HSEGTFTSDYSKYLDCRRAKDFVQWLMNT

SEQ ID NO: 359 - protein, 29 aa, Artificial Sequence
  Synthetic peptide
  MISC_FEATURE: c-term amidation
  MOD_RES (16)..(16): Cys-PEG
HSEGTFTSDYSKYLDCRAAKDFVQWLMNT

SEQ ID NO: 360 - protein, 29 aa, Artificial Sequence
  Synthetic peptide
  MISC_FEATURE: c-term amidation
  MOD_RES (16)..(16): Cys-PEG
HSEGTFTSDYSKYLDCQAAKEFIAWLMNT

SEQ ID NO: 361 - protein, 29 aa, Artificial Sequence
  Synthetic peptide
  MISC_FEATURE: c-term amidation
  MOD_RES (16)..(16): Cys-PEG
HSEGTFTSDYSKYLDCQAAKEFIAWLVKG

SEQ ID NO: 362 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSEGTFTSDYSKYLDCRRAKDFVQWLMNT

SEQ ID NO: 363 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSEGTFTSDYSKYLDCRAAKDFVQWLMNT

SEQ ID NO: 364 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSEGTFTSDYSKYLDCQAAKEFIAWLMNT

SEQ ID NO: 365 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSEGTFTSDYSKYLDCQAAKEFIAWLVKG

SEQ ID NO: 366 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCRRAKDFVQWLMNT

SEQ ID NO: 367 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCRAAKDFVQWLMNT

SEQ ID NO: 368 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCQAAKEFIAWLMNT

SEQ ID NO: 369 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCQAAKEFIAWLVKG

SEQ ID NO: 370 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCRRAKDFVQWLMNT

SEQ ID NO: 371 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCRAAKDFVQWLMNT

SEQ ID NO: 372 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCQAAKEFIAWLMNT

SEQ ID NO: 373 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCQAAKEFIAWLVKG

SEQ ID NO: 374 - protein, 29 aa, Artificial Sequence
  Synthetic peptide
  MISC_FEATURE: c-term amidation
HSQGTFTSDYSKYLDERRAQDFVQWLMDT

SEQ ID NO: 375 - protein, 29 aa, Artificial Sequence
  Synthetic peptide
  MISC_FEATURE: c-term amidation
HSQGTFTSDYSKYLDERRAKDFVQWLMDT

SEQ ID NO: 376 - protein, 29 aa, Artificial Sequence
  Synthetic peptide
  MISC_FEATURE: c-term amidation
  MISC_FEATURE (16)..(20): Lactam ring between side chains at positions 16 and 20
HSQGTFTSDYSKYLDERRAKDFVQWLMDT

SEQ ID NO: 377 - protein, 29 aa, Artificial Sequence
  Synthetic peptide
  MISC_FEATURE: c-term amidation
  MISC_FEATURE (12)..(16): Lactam ring between side chains at positions 12 and 16
HSQGTFTSDYSKYLDERRAQDFVQWLMDT

SEQ ID NO: 378 - protein, 29 aa, Artificial Sequence
  Synthetic peptide
  MISC_FEATURE: c-term amidation
  MISC_FEATURE (12)..(16): Lactam ring between side chains at positions 12 and 16
HSQGTFTSDYSKYLDERRAKDFVQWLMDT

SEQ ID NO: 379 - protein, 29 aa, Artificial Sequence
  Synthetic peptide
  MISC_FEATURE: c-term amidation
  MISC_FEATURE (16)..(20): Lactam ring between side chains at positions 16 and 20
HSQGTFTSDYSKYLDKRRAEDFVQWLMDT

SEQ ID NO: 380 - protein, 29 aa, Artificial Sequence
  Synthetic peptide
  MISC_FEATURE: c-term amidation
HSQGTFTSDYSKYLDERAAKDFVQWLMDT

SEQ ID NO: 381 - protein, 29 aa, Artificial Sequence
  Synthetic peptide
  MISC_FEATURE: c-term amidation; lactam ring between side chains at positions 16 and 20
HSQGTFTSDYSKYLDERAAKDFVQWLMDT

SEQ ID NO: 382 - protein, 29 aa, Artificial Sequence
  Synthetic peptide
  MISC_FEATURE: c-term amidation
  MISC_FEATURE (12)..(16): Lactam ring between side chains at positions 12 and 16
HSQGTFTSDYSKYLDERAAQDFVQWLMDT

SEQ ID NO: 383 - protein, 29 aa, Artificial Sequence
  Synthetic peptide
  MISC_FEATURE: c-term amidation
  MISC_FEATURE (12)..(16): Lactam ring between side chains at positions 12 and 16
HSQGTFTSDYSKYLDERAAKDFVQWLMDT

SEQ ID NO: 384 - protein, 29 aa, Artificial Sequence
  Synthetic peptide
  MISC_FEATURE: c-term amidation
  MISC_FEATURE (16)..(20): Lactam ring between side chains at positions 16 and 20
HSQGTFTSDYSKYLDKRAAEDFVQWLMDT

SEQ ID NO: 385 - protein, 29 aa, Artificial Sequence
  Synthetic peptide
  MISC_FEATURE: c-term amidation
HSQGTFTSDYSKYLDEQAAKEFIAWLMDT

SEQ ID NO: 386 - protein, 29 aa, Artificial Sequence
  Synthetic peptide
  MISC_FEATURE: c-term amidation
  MISC_FEATURE (12)..(16): Lactam ring between side chains at positions 12 and 16
HSQGTFTSDYSKYLDEQAAKEFIAWLMDT

SEQ ID NO: 387 - protein, 29 aa, Artificial Sequence
  Synthetic peptide
  MISC_FEATURE: c-term amidation
  MISC_FEATURE (16)..(20): Lactam ring between side chains at positions 16 and 20
HSQGTFTSDYSKYLDEQAAKEFIAWLMDT

SEQ ID NO: 388 - protein, 29 aa, Artificial Sequence
  Synthetic peptide
  MISC_FEATURE: c-term amidation
  MOD_RES (1)..(1): (Des-amino)His
XSQGTFTSDYSKYLDERRAQDFVQWLMDT

SEQ ID NO: 389 - protein, 29 aa, Artificial Sequence
  Synthetic peptide
  MISC_FEATURE: c-term amidation
  MOD_RES (1)..(1): (Des-amino)His
XSQGTFTSDYSKYLDERRAKDFVQWLMDT

SEQ ID NO: 390 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDERRAKDFVQWLMDT

SEQ ID NO: 391 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDERRAQDFVQWLMDT

SEQ ID NO: 392 - protein, 29 aa, Artificial Sequence
  Synthetic peptide
  misc_feature (1)..(1): Xaa can be any naturally occurring amino acid
XSQGTFTSDYSKYLDERRAKDFVQWLMDT

SEQ ID NO: 393 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDKRRAEDFVQWLMDT

SEQ ID NO: 394 - protein, 29 aa, Artificial Sequence
  Synthetic peptide
  MISC_FEATURE: c-term amidation
  MOD_RES (1)..(1): (Des-amino)His
XSQGTFTSDYSKYLDERAAKDFVQWLMDT

SEQ ID NO: 395 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDERAAKDFVQWLMDT

SEQ ID NO: 396 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDERAAQDFVQWLMDT

SEQ ID NO: 397 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDERAAKDFVQWLMDT

SEQ ID NO: 398 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDKRAAEDFVQWLMDT

SEQ ID NO: 399 - protein, 29 aa, Artificial Sequence
  Synthetic peptide
  MISC_FEATURE: c-term amidation
  MOD_RES (1)..(1): (Des-amino)His
XSQGTFTSDYSKYLDEQAAKEFIAWLMDT

SEQ ID NO: 400 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDEQAAKEFIAWLMDT

SEQ ID NO: 401 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDEQAAKEFIAWLMDT

SEQ ID NO: 402 - protein, 29 aa, Artificial Sequence
  Synthetic peptide
  MISC_FEATURE: c-term amidation
  MOD_RES (2)..(2): Aminoisobutyric acid
HXQGTFTSDYSKYLDERRAQDFVQWLMDT

SEQ ID NO: 403 - protein, 29 aa, Artificial Sequence
  Synthetic peptide
  MISC_FEATURE: c-term amidation
  MOD_RES (2)..(2): Aminoisobutyric acid
HXQGTFTSDYSKYLDERRAKDFVQWLMDT

SEQ ID NO: 404 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXQGTFTSDYSKYLDERRAKDFVQWLMDT

SEQ ID NO: 405 - protein, 29 aa, Artificial Sequence
  Synthetic peptide
  MISC_FEATURE: c-term amidation
  MOD_RES (2)..(2): aminoisobutyric acid
  MISC_FEATURE (12)..(16): Lactam ring between side chains at positions 12 and 16
HXQGTFTSDYSKYLDERRAQDFVQWLMDT

SEQ ID NO: 406 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXQGTFTSDYSKYLDERRAKDFVQWLMDT

SEQ ID NO: 407 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXQGTFTSDYSKYLDKRRAEDFVQWLMDT

SEQ ID NO: 408 - protein, 29 aa, Artificial Sequence
  Synthetic peptide
  MOD_RES (2)..(2): Aminoisobutyric acid
  MISC_FEATURE (2)..(2): c-term amidation
HXQGTFTSDYSKYLDERAAKDFVQWLMDT

SEQ ID NO: 409 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXQGTFTSDYSKYLDERAAKDFVQWLMDT

SEQ ID NO: 410 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXQGTFTSDYSKYLDERAAQDFVQWLMDT

SEQ ID NO: 411 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXQGTFTSDYSKYLDERAAKDFVQWLMDT

SEQ ID NO: 412 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 16 and 20
HXQGTFTSDYSKYLDKRAAEDFVQWLMDT

SEQ ID NO: 413 - protein, 29 aa, Artificial Sequence
  Synthetic peptide
  MISC_FEATURE: c-term amidation
  MOD_RES (2)..(2): Aminoisobutyric acid
HXQGTFTSDYSKYLDEQAAKEFIAWLMDT

SEQ ID NO: 414 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXQGTFTSDYSKYLDEQAAKEFIAWLMDT

SEQ ID NO: 415 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXQGTFTSDYSKYLDEQAAKEFIAWLMDT

SEQ ID NO: 416 - protein, 29 aa, Artificial Sequence
  Synthetic peptide
  MISC_FEATURE: c-term amidation
  MOD_RES (2)..(2): D-Ala
HXQGTFTSDYSKYLDERRAQDFVQWLMDT

SEQ ID NO: 417 - protein, 29 aa, Artificial Sequence
  Synthetic peptide
  MISC_FEATURE: c-term amidation
  MOD_RES (2)..(2): D-Ala
HXQGTFTSDYSKYLDERRAKDFVQWLMDT

SEQ ID NO: 418 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDERRAKDFVQWLMDT

SEQ ID NO: 419 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDERRAQDFVQWLMDT

SEQ ID NO: 420 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDERRAKDFVQWLMDT

SEQ ID NO: 421 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDKRRAEDFVQWLMDT

SEQ ID NO: 422 - protein, 29 aa, Artificial Sequence
  Synthetic peptide
  MISC_FEATURE: c-term amidation
  MOD_RES (2)..(2): D-Ala
HXQGTFTSDYSKYLDERAAKDFVQWLMDT

SEQ ID NO: 423 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDERAAKDFVQWLMDT

SEQ ID NO: 424 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDERAAQDFVQWLMDT

SEQ ID NO: 425 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDERAAKDFVQWLMDT

SEQ ID NO: 426 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDKRAAEDFVQWLMDT

SEQ ID NO: 427 - protein, 29 aa, Artificial Sequence
  Synthetic peptide
  MISC_FEATURE: c-term amidation
  MOD_RES (2)..(2): D-Ala
HXQGTFTSDYSKYLDEQAAKEFIAWLMDT

SEQ ID NO: 428 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDEQAAKEFIAWLMDT

SEQ ID NO: 429 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDEQAAKEFIAWLMDT

SEQ ID NO: 430 - protein, 29 aa, Artificial Sequence
  Synthetic peptide
  MISC_FEATURE: c-term amidation
HSEGTFTSDYSKYLDERRAQDFVQWLMDT

SEQ ID NO: 431 - protein, 29 aa, Artificial Sequence
  Synthetic peptide
  MISC_FEATURE: c-term amidation
HSEGTFTSDYSKYLDERRAKDFVQWLMDT

SEQ ID NO: 432 - protein, 29 aa, Artificial Sequence
  Synthetic peptide
  MISC_FEATURE: c-term amidation
  MISC_FEATURE (16)..(20): Lactam ring between side chains at positions 16 and 20
HSEGTFTSDYSKYLDERRAKDFVQWLMDT

SEQ ID NO: 433 - protein, 29 aa, Artificial Sequence
  Synthetic peptide
  MISC_FEATURE: c-term amidation
  MISC_FEATURE (16)..(16): Lactam ring between side chains at positions 12 and 16
HSEGTFTSDYSKYLDERRAQDFVQWLMDT

SEQ ID NO: 434 - protein, 29 aa, Artificial Sequence
  Synthetic peptide
  MISC_FEATURE: c-term amidation
  MISC_FEATURE (12)..(16): Lactam ring between side chains at positions 12 and 16
HSEGTFTSDYSKYLDERRAKDFVQWLMDT

SEQ ID NO: 435 - protein, 29 aa, Artificial Sequence
  Synthetic peptide
  MISC_FEATURE: c-term amidation
  MISC_FEATURE (16)..(20): Lactam ring between side chains at positions 16 and 20
HSEGTFTSDYSKYLDKRRAEDFVQWLMDT

SEQ ID NO: 436 - protein, 29 aa, Artificial Sequence
  Synthetic peptide
  MISC_FEATURE: c-term amidation
HSEGTFTSDYSKYLDERAAKDFVQWLMDT

SEQ ID NO: 437 - protein, 29 aa, Artificial Sequence
  Synthetic peptide
  MISC_FEATURE: c-term amidation
  MISC_FEATURE: Lactam ring between side chains at positions 16 and 20
HSEGTFTSDYSKYLDERAAKDFVQWLMDT

SEQ ID NO: 438 - protein, 29 aa, Artificial Sequence
  Synthetic peptide
  MISC_FEATURE: c-term amidation
  MISC_FEATURE (12)..(16): Lactam ring between side chains at positions 12 and 16
HSEGTFTSDYSKYLDERAAQDFVQWLMDT

SEQ ID NO: 439 - protein, 29 aa, Artificial Sequence
  Synthetic peptide
  MISC_FEATURE: c-term amidation
  MISC_FEATURE (12)..(16): Lactam ring between side chains at positions 12 and 16
HSEGTFTSDYSKYLDERAAKDFVQWLMDT

SEQ ID NO: 440 - protein, 29 aa, Artificial Sequence
  Synthetic peptide
  MISC_FEATURE: c-term amidation
  MISC_FEATURE (16)..(20): Lactam ring between side chains at positions 16 and 20
HSEGTFTSDYSKYLDKRAAEDFVQWLMDT

SEQ ID NO: 441 - protein, 29 aa, Artificial Sequence
  Synthetic peptide
  MISC_FEATURE: c-term amidation
HSEGTFTSDYSKYLDEQAAKEFIAWLMDT

SEQ ID NO: 442 - protein, 29 aa, Artificial Sequence
  Synthetic peptide
  MISC_FEATURE: c-term amidation
  MISC_FEATURE (12)..(16): Lactam ring between side chains at positions 12 and 16
HSEGTFTSDYSKYLDEQAAKEFIAWLMDT

SEQ ID NO: 443 - protein, 29 aa, Artificial Sequence
  Synthetic peptide
  MISC_FEATURE: c-term amidation
  MISC_FEATURE (16)..(20): Lactam ring between side chains at positions 16 and 20
HSEGTFTSDYSKYLDEQAAKEFIAWLMDT

SEQ ID NO: 444 - protein, 29 aa, Artificial Sequence
  Synthetic peptide
  MISC_FEATURE: c-term amidation
  MOD_RES (1)..(1): (Des-amino)His
XSEGTFTSDYSKYLDERRAQDFVQWLMDT

SEQ ID NO: 445 - protein, 29 aa, Artificial Sequence
  Synthetic peptide
  MISC_FEATURE: c-term amidation
  MOD_RES (1)..(1): (Des-amino)His
XSEGTFTSDYSKYLDERRAKDFVQWLMDT

SEQ ID NO: 446 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDERRAKDFVQWLMDT

SEQ ID NO: 447 - protein, 29 aa, Artificial Sequence
  Synthetic peptide
  MISC_FEATURE: c-term amidation
  MISC_FEATURE: Lactam ring between side chains at positions 12 and 16
  MOD_RES (1)..(1): (Des-amino)His
XSEGTFTSDYSKYLDERRAQDFVQWLMDT

SEQ ID NO: 448 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
XSEGTFTSDYSKYLDERRAKDFVQWLMDT

SEQ ID NO: 449 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDKRRAEDFVQWLMDT

SEQ ID NO: 450 - protein, 29 aa, Artificial Sequence
  Synthetic peptide
  MISC_FEATURE: c-term amidation
  MOD_RES (1)..(1): (Des-amino)His
XSEGTFTSDYSKYLDERAAKDFVQWLMDT

SEQ ID NO: 451 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDERAAKDFVQWLMDT

SEQ ID NO: 452 - protein, 29 aa, Artificial Sequence
  Synthetic peptide
  MISC_FEATURE: C-term amidation
  MOD_RES (1)..(1): (Des-amino)His
  MISC_FEATURE (12)..(16): Lactam ring between side chains at positions 12 and 16
XSEGTFTSDYSKYLDERAAQDFVQWLMDT

SEQ ID NO: 453 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
XSEGTFTSDYSKYLDERAAKDFVQWLMDT

SEQ ID NO: 454 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDKRAAEDFVQWLMDT

SEQ ID NO: 455 - protein, 29 aa, Artificial Sequence
  Synthetic peptide
  MISC_FEATURE: c-term amidation
  MOD_RES (1)..(1): (Des-amino)His
XSEGTFTSDYSKYLDEQAAKEFIAWLMDT

SEQ ID NO: 456 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
XSEGTFTSDYSKYLDEQAAKEFIAWLMDT

SEQ ID NO: 457 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDEQAAKEFIAWLMDT

SEQ ID NO: 458 - protein, 29 aa, Artificial Sequence
  Synthetic peptide
  MISC_FEATURE: c-term amidation
  MOD_RES (2)..(2): Aminoisobutyric acid
HXEGTFTSDYSKYLDERRAQDFVQWLMDT

SEQ ID NO: 459 - protein, 29 aa, Artificial Sequence
  Synthetic peptide
  MISC_FEATURE: c-term amidation
  MOD_RES (2)..(2): Aminoisobutyric acid
HXEGTFTSDYSKYLDERRAKDFVQWLMDT

SEQ ID NO: 460 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDERRAKDFVQWLMDT

SEQ ID NO: 461 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDERRAQDFVQWLMDT

SEQ ID NO: 462 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDERRAKDFVQWLMDT

SEQ ID NO: 463 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDKRRAEDFVQWLMDT

SEQ ID NO: 464 - protein, 29 aa, Artificial Sequence
  Synthetic peptide
  MISC_FEATURE: c-term amidation
  MOD_RES (2)..(2): Aminoisobutyric acid
HXEGTFTSDYSKYLDERAAKDFVQWLMDT

SEQ ID NO: 465 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDERAAKDFVQWLMDT

SEQ ID NO: 466 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at postions 12 and 16
HXEGTFTSDYSKYLDERAAQDFVQWLMDT

SEQ ID NO: 467 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDERAAKDFVQWLMDT

SEQ ID NO: 468 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 16 and 20
HXEGTFTSDYSKYLDKRAAEDFVQWLMDT

SEQ ID NO: 469 - protein, 29 aa, Artificial Sequence
  Synthetic peptide
  MISC_FEATURE: c-term amidation
  MOD_RES (2)..(2): Aminoisobutyric acid
HXEGTFTSDYSKYLDEQAAKEFIAWLMDT

SEQ ID NO: 470 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDEQAAKEFIAWLMDT

SEQ ID NO: 471 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDEQAAKEFIAWLMDT

SEQ ID NO: 472 - protein, 29 aa, Artificial Sequence
  Synthetic peptide
  MISC_FEATURE: c-term amidation
  MOD_RES (2)..(2): D-Ala
HXEGTFTSDYSKYLDERRAQDFVQWLMDT

SEQ ID NO: 473 - protein, 29 aa, Artificial Sequence
  Synthetic peptide
  MISC_FEATURE: c-term amidation
  MOD_RES (2)..(2): D-Ala
HXEGTFTSDYSKYLDERRAKDFVQWLMDT

SEQ ID NO: 474 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDERRAKDFVQWLMDT

SEQ ID NO: 475 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDERRAQDFVQWLMDT

SEQ ID NO: 476 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDERRAKDFVQWLMDT

SEQ ID NO: 477 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDKRRAEDFVQWLMDT

SEQ ID NO: 478 - protein, 29 aa, Artificial Sequence
  Synthetic peptide
  MISC_FEATURE: c-term amidation
  MOD_RES (2)..(2): D-Ala
HXEGTFTSDYSKYLDERAAKDFVQWLMDT

SEQ ID NO: 479 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDERAAKDFVQWLMDT

SEQ ID NO: 480 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDERAAQDFVQWLMDT

SEQ ID NO: 481 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDERAAKDFVQWLMDT

SEQ ID NO: 482 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDKRAAEDFVQWLMDT

SEQ ID NO: 483 - protein, 29 aa, Artificial Sequence
  Synthetic peptide
  MISC_FEATURE: c-term amidation
  MOD_RES (2)..(2): D-Ala
HXEGTFTSDYSKYLDEQAAKEFIAWLMDT

SEQ ID NO: 484 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDEQAAKEFIAWLMDT

SEQ ID NO: 485 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDEQAAKEFIAWLMDT

SEQ ID NO: 486 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDEQAAKEFICWLMNT

SEQ ID NO: 487 - protein, 29 aa, Artificial Sequence
  Synthetic peptide
  MISC_FEATURE: c-term amidation
  MOD_RES (2)..(2): Aminoisobutyric acid
  MOD_RES (29)..(29): Cys-PEG
HXQGTFTSDYSKYLDEQAAKEFIAWLMNC

SEQ ID NO: 488 - protein, 40 aa, Artificial Sequence
  Synthetic peptide
  MISC_FEATURE: c-term amidation
  MOD_RES (2)..(2): Aminoisobutyric acid
  MOD_RES (40)..(40): Cys-PEG
HXQGTFTSDYSKYLDEQAAKEFIAWLMNGGPSSGAPPPSC

SEQ ID NO: 489 - protein, 40 aa, Artificial Sequence; identical to SEQ ID NO: 488
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (40)..(40): Cys-PEG

SEQ ID NO: 490 - protein, 39 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDEQAAKEFICWLMNGGPSSGAPPPS

SEQ ID NO: 491 - protein, 39 aa, Artificial Sequence; identical to SEQ ID NO: 490
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG

SEQ ID NO: 492 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERAAKDFVCWLMNT

SEQ ID NO: 493 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERAAKDFVQWLMNC

SEQ ID NO: 494 - protein, 40 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERAAKDFVQWLMNGGPSSGAPPPSC

SEQ ID NO: 495 - protein, 40 aa, Artificial Sequence; identical to SEQ ID NO: 494
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (40)..(40): Cys-PEG

SEQ ID NO: 496 - protein, 39 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERAAKDFVCWLMNGGPSSGAPPPS

SEQ ID NO: 497 - protein, 39 aa, Artificial Sequence; identical to SEQ ID NO: 496
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG

SEQ ID NO: 498 - protein, 30 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERRAKDFVCWLMNTA

SEQ ID NO: 499 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERRAKDFVQWLMNC

SEQ ID NO: 500 - protein, 40 aa, Artificial Sequence
  Synthetic peptide
  MISC_FEATURE: c-term amidation
  MOD_RES (2)..(2): Aminoisobutyric acid
  MOD_RES (40)..(40): Cys-PEG
HXQGTFTSDYSKYLDERRAKDFVQWLMNGGPSSGAPPPSC

SEQ ID NO: 501 - protein, 40 aa, Artificial Sequence; identical to SEQ ID NO: 500
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (40)..(40): Cys-PEG

SEQ ID NO: 502 - protein, 39 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERRAKDFVCWLMNGGPSSGAPPPS

SEQ ID NO: 503 - protein, 39 aa, Artificial Sequence; identical to SEQ ID NO: 502
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG

SEQ ID NO: 504 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXQGTFTSDYSKYLDEQAAKEFICWLMNT

SEQ ID NO: 505 - protein, 29 aa, Artificial Sequence
  Synthetic peptide
  MISC_FEATURE: c-term amidation
  MOD_RES (1)..(1): Alpha, Alpha-Dimethyl Imidiazole Acetic Acid
  MISC_FEATURE (16)..(20): Lactam ring between side chains at positions 16 and 20
  MOD_RES (24)..(24): Cys-PEG
XSQGTFTSDYSKYLDEQAAKEFICWLMNT

SEQ ID NO: 506 - protein, 29 aa, Artificial Sequence
  Synthetic peptide
  MISC_FEATURE: c-term amidation
  MOD_RES (1)..(1): Alpha, Alpha-Dimethly Imidiazole Acetic Acid
  MOD_RES (1)..(1): Alpha, Alpha-Dimethly Imidiazole Acetic Acid
  MISC_FEATURE (16)..(20): Lactam ring between side chains at positions 16 and 20
  MOD_RES (29)..(29): Cys-PEG
XSQGTFTSDYSKYLDEQAAKEFIAWLMNC

SEQ ID NO: 507 - protein, 40 aa, Artificial Sequence
  Synthetic peptide
  MISC_FEATURE: c-term amidation
  MOD_RES (1)..(1): Alpha, Alpha Dimethyl Imidiazole Acetic Acid
  MISC_FEATURE (16)..(20): Lactam ring between side chains at positions 16 and 20
  MOD_RES (40)..(40): Cys-PEG
XSQGTFTSDYSKYLDEQAAKEFIAWLMNGGPSSGAPPPSC

SEQ ID NO: 508 - protein, 40 aa, Artificial Sequence
  Synthetic peptide
  MISC_FEATURE: c-term amidation
  MOD_RES (1)..(1): Alpha, Alpha Dimethyl Imidiazole Acetic Acid
  MISC_FEATURE (16)..(20): Lactam ring between side chains at positions 16 and 20
  MOD_RES (40)..(40): Cys-PEG
XSQGTFTSDYSKYLDERRAKDFVQWLMNGGPSSGAPPPSC

SEQ ID NO: 509 - protein, 39 aa, Artificial Sequence
  Synthetic peptide
  MISC_FEATURE: c-term amidation
  MOD_RES (1)..(1): Alpha, Alpha Dimethyl Imidiazole Acetic Acid
  MISC_FEATURE (16)..(20): Lactam ring between side chains at positions 16 and 20
  MOD_RES (24)..(24): Cys-PEG
XSQGTFTSDYSKYLDEQAAKEFICWLMNGGPSSGAPPPS

SEQ ID NO: 510 - protein, 29 aa, Artificial Sequence
  Synthetic peptide
  MISC_FEATURE: c-term amidation
  MOD_RES (1)..(1): Alpha, Alpha Dimethyl Imidiazole Acetic Acid
  misc_feature (2)..(2): Xaa can be any naturally occurring amino acid
  MISC_FEATURE (16)..(20): Lactam ring between side chains at positions 16 and 20
  MOD_RES (24)..(24): Cys-PEG
HXQGTFTSDYSKYLDERRAKDFVCWLMNT

SEQ ID NO: 511 - protein, 29 aa, Artificial Sequence
  Synthetic peptide
  MISC_FEATURE: c-term amidation
  MOD_RES (2)..(2): Alpha, Alpha Dimethyl Imidiazole Acetic Acid
  MISC_FEATURE (16)..(20): Lactam ring between side chains at positions 16 and 20
  MOD_RES (24)..(24): Cys-PEG
HXQGTFTSDYSKYLDERRAKDFVCWLMNT

SEQ ID NO: 512 - protein, 29 aa, Artificial Sequence
  Synthetic peptide
  MISC_FEATURE: c-term amidation
  MOD_RES (1)..(1): Alpha, Alpha Dimethyl Imidiazole Acetic Acid
  MISC_FEATURE (16)..(20): Lactam ring between side chains at positions 16 and 20
  MOD_RES (29)..(29): Cys-PEG
XSQGTFTSDYSKYLDERRAKDFVQWLMNC

SEQ ID NO: 513 - protein, 39 aa, Artificial Sequence
  Synthetic peptide
  MISC_FEATURE: c-term amidation
  MOD_RES (1)..(1): Alpha, Alpha Dimethyl Imidiazole Acetic Acid
  MISC_FEATURE (16)..(20): Lactam ring between side chains at positions 16 and 20
  MOD_RES (24)..(24): Cys-PEG
XSQGTFTSDYSKYLDERRAKDFVCWLMNGGPSSGAPPPS

SEQ ID NO: 514 - protein, 29 aa, Artificial Sequence
  Synthetic peptide
  MISC_FEATURE: c-term amidation
  MISC_FEATURE (16)..(20): Lactam ring between side chains at positions 16 and 20
  MOD_RES (24)..(24): Cys-PEG
HSQGTFTSDYSKYLDEQAAKEFICWLMNT

SEQ ID NO: 515 - protein, 11 aa, Artificial Sequence
  Synthetic peptide
GGPSSGAPPPS

SEQ ID NO: 516 - protein, 12 aa, Artificial Sequence
  Synthetic peptide
  MOD_RES (12)..(12): Cys-PEG
GGPSSGAPPPSC

SEQ ID NO: 517 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXQGTFTSDYSKYLDERRAKDFVCWLMNT

SEQ ID NO: 518 - protein, 29 aa, Artificial Sequence
  Synthetic peptide
  MISC_FEATURE: c-term amidation
  MOD_RES (24)..(24): Cys-PEG
HSQGTFTSDYSKYLDEQAAKEFICWLMNT

SEQ ID NO: 519 - protein, 29 aa, Artificial Sequence
  Synthetic peptide
  MISC_FEATURE: c-term amidation
  MOD_RES (1)..(1): Alpha, Alpha Dimethly Imidiazole Acetic Acid
  MOD_RES (24)..(24): Cys-PEG
XSQGTFTSDYSKYLDEQAAKEFICWLMNT

SEQ ID NO: 520 - protein, 29 aa, Artificial Sequence
  Synthetic peptide
  MISC_FEATURE: c-term amidation
  MOD_RES (1)..(1): Alpha, Alpha Dimethyl Imidiazole Acetic Acid
  MOD_RES (29)..(29): Cys-PEG
XSQGTFTSDYSKYLDEQAAKEFIAWLMNC

SEQ ID NO: 521 - protein, 39 aa, Artificial Sequence
  Synthetic peptide
  MISC_FEATURE: c-term amidation
HSQGTFTSDYSKYLDSRRAQDFVQWLMNTGPSSGAPPPS

SEQ ID NO: 522 - protein, 39 aa, Artificial Sequence
  Synthetic peptide
  MISC_FEATURE: c-term amidation
HSQGTFTSDYSKYLDSRRAQDFVQWLMNGGPSSGAPPPS

SEQ ID NO: 523 - protein, 39 aa, Artificial Sequence
  Synthetic peptide
  MISC_FEATURE: c-term amidation
HSQGTFTSDYSKYLDSRRAQDFVQWLMKGGPSSGAPPPS

SEQ ID NO: 524 - protein, 39 aa, Artificial Sequence
  Synthetic peptide
  MISC_FEATURE: c-term amidation
HSQGTFTSDYSKYLDSRRAQDFVQWLVKGGPSSGAPPPS

SEQ ID NO: 525 - protein, 39 aa, Artificial Sequence
  Synthetic peptide
  MISC_FEATURE: c-term amidation
HSQGTFTSDYSKYLDSRRAQDFVQWLMDGGPSSGAPPPS

SEQ ID NO: 526 - protein, 39 aa, Artificial Sequence
  Synthetic peptide
  MISC_FEATURE: c-term amidation
HSQGTFTSDYSKYLDERRAKDFVQWLMDGGPSSGAPPPS

SEQ ID NO: 527 - protein, 30 aa, Artificial Sequence
  Synthetic peptide
  MISC_FEATURE: c-term amidation
HAEGTFTSDVSSYLEGQAAKEFIAWLVKGG

SEQ ID NO: 528 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXQGTFTSDYSKYLDERRAKDFVCWLMNT

SEQ ID NO: 529 - protein, 39 aa, Artificial Sequence; identical to SEQ ID NO: 513
  Synthetic peptide
  MISC_FEATURE: c-term amidation
  MOD_RES (1)..(1): Alpha, Alpha Dimethyl Imidiazole Acetic Acid
  MOD_RES (24)..(24): Cys-PEG

SEQ ID NO: 530 - protein, 29 aa, Artificial Sequence
  Synthetic peptide
  MISC_FEATURE: c-term amidation
  MOD_RES (1)..(1): Alpha, Alpha Dimethyl Imidiazole Acetic Acid
  MOD_RES (24)..(24): Cys-PEG
XSQGTFTSDYSKYLDERRAKDFVCWLMNT

SEQ ID NO: 531 - protein, 40 aa, Artificial Sequence
  Synthetic peptide
  MISC_FEATURE: c-term amidation
  MOD_RES (2)..(2): Aminoisobutyric acid
  MOD_RES (24)..(24): Cys-PEG
  MOD_RES (40)..(40): Cys-PEG
HXQGTFTSDYSKYLDERRAKEFICWLMNGGPSSGAPPPSC

SEQ ID NO: 532 - protein, 41 aa, Artificial Sequence
  Synthetic peptide
  MISC_FEATURE: c-term amidation
  MOD_RES (2)..(2): Aminoisobutyric acid
  MOD_RES (40)..(40): Cys-PEG
  MOD_RES (41)..(41): Cys-PEG
HXQGTFTSDYSKYLDEQAAKEFIAWLMNGGPSSGAPPPSCC

SEQ ID NO: 533 - protein, 39 aa, Artificial Sequence; identical to SEQ ID NO: 490
  Synthetic peptide
  MOD_RES (2)..(2): Aminoisobutyric acid
  MOD_RES (24)..(24): Cys-PEG
  MISC_FEATURE (24)..(24): c-term amidation

SEQ ID NO: 534 - protein, 29 aa, Artificial Sequence
  Synthetic peptide
  MISC_FEATURE: Chimera 2 AIB2 K10-C8 Cys 24-40K
  MISC_FEATURE: c-term amidation
  MOD_RES (2)..(2): Aminoisobutyric acid
  MOD_RES (10)..(10): Acylated with C8 fatty acid
  MOD_RES (24)..(24): Cys-PEG
HXQGTFTSDKSKYLDEQAAKEFICWLMNT

SEQ ID NO: 535 - protein, 29 aa, Artificial Sequence
  Synthetic peptide
  MISC_FEATURE: Chimera 2 AIB2 K10-C14 Cys 24-40K
  MISC_FEATURE: c-term amidation
  MOD_RES (2)..(2): Aminoisobutyric acid
  MOD_RES (10)..(10): Acylated with C14 fatty acid
  MOD_RES (24)..(24): Cys-PEG
HXQGTFTSDKSKYLDEQAAKEFICWLMNT

SEQ ID NO: 536 - protein, 29 aa, Artificial Sequence
  Synthetic peptide
  MISC_FEATURE: Chimera 2 AIB2 K10-C16 Cys24-40K
  MISC_FEATURE: c-term amidation
  MOD_RES (2)..(2): Aminoisobutyric acid
  MOD_RES (10)..(10): Acylated with C16 fatty acid
  MOD_RES (24)..(24): Cys-PEG
HXQGTFTSDKSKYLDEQAAKEFICWLMNT

SEQ ID NO: 537 - protein, 29 aa, Artificial Sequence
  Synthetic peptide
  MISC_FEATURE: Chimera 2 AIB2 K10-C18 Cys24-40K
  MISC_FEATURE: c-term amidation
  MOD_RES (2)..(2): Aminoisobutyric acid
  MOD_RES (10)..(10): Acylated with C18 fatty acid
  MOD_RES (24)..(24): Cys-PEG
HXQGTFTSDKSKYLDEQAAKEFICWLMNT

SEQ ID NO: 538 - protein, 29 aa, Artificial Sequence
  Synthetic peptide
  MISC_FEATURE: Chimera 2 K10-C18 Cys24-40K
  MISC_FEATURE: c-term amidation
  MOD_RES (10)..(10): Acylated with C18 fatty acid
  MOD_RES (24)..(24): Cys-PEG
HSQGTFTSDKSKYLDEQAAKEFICWLMNT

SEQ ID NO: 539 - protein, 29 aa, Artificial Sequence
  Synthetic peptide
  MISC_FEATURE: Glucagon E16 K20 K10-C18 Cys24-40K
  MOD_RES (10)..(10): Acylated with C18 fatty acid
  MOD_RES (24)..(24): Cys-PEG
HSQGTFTSDKSKYLDERRAKDFVCWLMNT

SEQ ID NO: 540 - protein, 29 aa, Artificial Sequence
  Synthetic peptide
  MISC_FEATURE: Glucagon E16 K20 K10-W-C18
  MISC_FEATURE: c-term amidation
  MOD_RES (10)..(10): Covalently bound to Trp residue comprising a C18 fatty acid
HSQGTFTSDKSKYLDERRAKDFVQWLMNT

SEQ ID NO: 541 - protein, 29 aa, Artificial Sequence
  Synthetic peptide
  MISC_FEATURE: Glucagon E16 K20 K10-W-C16 Cys24-40K
  MOD_RES (10)..(10): Covalently bound to Trp residue comprising a C16 fatty acid
  MOD_RES (24)..(24): Cys-PEG
HSQGTFTSDKSKYLDERRAKDFVCWLMNT

SEQ ID NO: 542 - protein, 29 aa, Artificial Sequence
  Synthetic peptide
  MISC_FEATURE: Glucagon E16 K20 K10-C16
  MISC_FEATURE: c-term amidation
  MOD_RES (10)..(10): Covalently bound to C16 fatty acid
HSQGTFTSDKSKYLDERRAKDFVQWLMNT

SEQ ID NO: 543 - protein, 29 aa, Artificial Sequence
  Synthetic peptide
  MISC_FEATURE: Glucagon E16 K20 K10-C16
  MISC_FEATURE: c-term amidation
  MOD_RES (10)..(10): Covalently bound to Trp residue comprising a C16 fatty acid
HSQGTFTSDKSKYLDERRAKDFVQWLMNT

SEQ ID NO: 544 - protein, 29 aa, Artificial Sequence
  Synthetic peptide
  MISC_FEATURE: Glucagon E16 K20 K10-C18
  MISC_FEATURE: c-term amidation
  MOD_RES (10)..(10): Covalently bound to C18 fatty acid
HSQGTFTSDKSKYLDERRAKDFVQWLMNT

SEQ ID NO: 545 - protein, 29 aa, Artificial Sequence
  Synthetic peptide
  MISC_FEATURE: Glucagon E16 K20
  MISC_FEATURE: c-term amidation
HSQGTFTSDYSKYLDERRAKDFVQWLMNT

SEQ ID NO: 546 - protein, 29 aa, Artificial Sequence
  Synthetic peptide
  MISC_FEATURE: Glucagon E16 K20 K10-W-C16 Cys 24-40K
  MISC_FEATURE: c-term amidation
  MOD_RES (10)..(10): Covalently bound to Trp residue comprising C16 fatty acid
  MOD_RES (24)..(24): Cys-PEG
HSQGTFTSDKSKYLDERRAKDFVCWLMNT

SEQ ID NO: 547 - protein, 29 aa, Artificial Sequence
  Synthetic peptide
  MISC_FEATURE: Glucagon E16 K20 K10-C18 Cys24-40K
  MISC_FEATURE: c-term amidation
  MOD_RES (10)..(10): Covalently bound to C18 fatty acid
  MOD_RES (24)..(24): Cys-PEG
HSQGTFTSDKSKYLDERRAKDFVCWLMNT

SEQ ID NO: 548 - protein, 29 aa, Artificial Sequence
  Synthetic peptide
  MISC_FEATURE: Glucagon E16 K20 K10-C18 Cys24-40K
  MISC_FEATURE: c-term amidation
  MOD_RES (10)..(10): Covalently bound to Trp residue comprising a C18 fatty acid
  MOD_RES (24)..(24): Cys-PEG
HSQGTFTSDKSKYLDERRAKDFVCWLMNT

SEQ ID NO: 549 - protein, 29 aa, Artificial Sequence
  Synthetic peptide
  MISC_FEATURE: Glucagon E16 K20 K10-C16 amide
  MISC_FEATURE: c-term amidation
  MOD_RES (10)..(10): Covalently bound to Glu residue comprising a C16 fatty acid
  MOD_RES (24)..(24): Cys-PEG
HSQGTFTSDKSKYLDERRAQDFVCWLMNT

SEQ ID NO: 550 - protein, 28 aa, Artificial Sequence
  Synthetic peptide
  MISC_FEATURE: Chimera 2 truncated by one amino acid
HSQGTFTSDYSKYLDEQAAKEFIAWLMN

SEQ ID NO: 551 - protein, 27 aa, Artificial Sequence
  Synthetic peptide
  MISC_FEATURE: Chimera 2 truncated by two amino acids
HSQGTFTSDYSKYLDEQAAKEFIAWLM

SEQ ID NO: 552 - protein, 28 aa, Artificial Sequence
  Synthetic peptide
  MISC_FEATURE: aa 1-28, E16 K20 C-terminal amide
  MISC_FEATURE: c-term amidation
HSQGTFTSDYSKYLDERRAKDFVQWLMN

SEQ ID NO: 553 - protein, 27 aa, Artificial Sequence
  Synthetic peptide
  MISC_FEATURE: aa 1-27 E16 K20 C-terminal amide
  MISC_FEATURE: c-term amidation
HSQGTFTSDYSKYLDERRAKDFVQWKM

SEQ ID NO: 554 - protein, 29 aa, Artificial Sequence
  Synthetic peptide
  MISC_FEATURE: c-term amidation
  MOD_RES (27)..(27): Norleucine
HSEGTFTSDYSKYLDEQAAKEFIAWLXNT

SEQ ID NO: 555 - protein, 39 aa, Artificial Sequence
  Synthetic peptide
  MISC_FEATURE (16)..(20): Lactam bridging side chains at positions 16 and 20
YSQGTFTSDYSKYLDEQAAKEFVNWLMNGGPSSGAPPPS

SEQ ID NO: 556 - protein, 29 aa, Artificial Sequence
  Synthetic peptide
  MISC_FEATURE: Chimera 2 with AIB at 16
  MISC_FEATURE: c-term amidation
  MOD_RES (16)..(16): Aminoisobutyric acid
HSQGTFTSDYSKYLDXQAAKEFIAWLMNT

SEQ ID NO: 557 - protein, 29 aa, Artificial Sequence
  Synthetic peptide
  MISC_FEATURE: c-term amidation
  MOD_RES (2)..(2): Aminoisobutyric acid
  MOD_RES (16)..(16): Aminoisobutyric acid
HXQGTFTSDYSKYLDXRRAQDFVQWLMNT

SEQ ID NO: 558 - protein, 29 aa, Artificial Sequence
  Synthetic peptide
  MISC_FEATURE: c-term amidation
  MOD_RES (2)..(2): Aminoisobutyric acid
  MISC_FEATURE (10)..(10): Covalently bound to Trp residue comprising a C16 fatty acid
  MOD_RES (16)..(16): Aminoisobutyric acid
  MOD_RES (24)..(24): Cys-PEG
HXQGTFTSDKSKYLDXRRAQDFVCWLMNT

SEQ ID NO: 559 - protein, 29 aa, Artificial Sequence
  Synthetic peptide
  MISC_FEATURE: c-term amidation
  MOD_RES (2)..(2): Aminoisobutric Acid
  MISC_FEATURE (10)..(10): Covalently bound to Trp residue comprising a C16 fatty acid
  MOD_RES (16)..(16): Aminoisobutric Acid
HXQGTFTSDKSKYLDXRRAQDFVCWLMNT

SEQ ID NO: 560 - protein, 29 aa, Artificial Sequence
  Synthetic peptide
  MISC_FEATURE: c-term amidation
  MOD_RES (2)..(2): Aminoisobutyric acid
  MISC_FEATURE (10)..(10): Covalently bound to Trp residue comprising a C16 fatty acid
  MOD_RES (16)..(16): Aminoisobutyric acid
  MOD_RES (20)..(20): Aminoisobutyric acid
  MOD_RES (24)..(24): Cys-PEG
HXQGTFTSDKSKYLDXRRAXDFVCWLMNT

SEQ ID NO: 561 - protein, 29 aa, Artificial Sequence
  Synthetic peptide
  MISC_FEATURE: c-term amidation
  MOD_RES (2)..(2): Aminoisobutyric acid
  MISC_FEATURE (10)..(10): Covalently bound to Trp residue comprising a C16 fatty acid
  MOD_RES (16)..(16): Aminoisobutyric acid
  MOD_RES (20)..(20): Aminoisobutyric acid
HXQGTFTSDKSKYLDXRRAXDFVCWLMNT

SEQ ID NO: 562 - protein, 29 aa, Artificial Sequence
  Synthetic peptide
  MISC_FEATURE: c-term amidation
  MOD_RES (2)..(2): Aminoisobutyric acid
  MOD_RES (16)..(16): Aminoisobutyric acid
HXQGTFTSDKSKYLDXRRAQDFVQWLMNT

SEQ ID NO: 563 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Acylated with a C16 fatty acyl group
  MOD_RES (16)..(16): Aminoisobutyric Acid
HXQGTFTSDKSKYLDXRRAQDFVQWLMNT

SEQ ID NO: 564 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Acylated with a C16 fatty acyl group via Ala-Ala spacer
  MOD_RES (16)..(16): Aminoisobutyric Acid
HXQGTFTSDKSKYLDXRRAQDFVQWLMNT

SEQ ID NO: 565 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via gamma-Glu-gamma-Glu spacer
  MOD_RES (16)..(16): Aminoisobutryic Acid
HXQGTFTSDKSKYLDXRRAQDFVQWLMNT

SEQ ID NO: 566 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via beta-Ala-beta-Ala spacer
  MOD_RES (16)..(16): Aminoisobutryic Acid
HXQGTFTSDKSKYLDXRRAQDFVQWLMNT

SEQ ID NO: 567 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via 6-aminohexanoic acid spacer
  MOD_RES (16)..(16): Aminoisobutryic Acid
HXQGTFTSDKSKYLDXRRAQDFVQWLMNT

SEQ ID NO: 568 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via Leu-Leu spacer
  MOD_RES (16)..(16): Aminoisobutryic Acid
HXQGTFTSDKSKYLDXRRAQDFVQWLMNT

SEQ ID NO: 569 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via Pro-Pro spacer
  MOD_RES (16)..(16): Aminoisobutryic Acid
HXQGTFTSDKSKYLDXRRAQDFVQWLMNT

SEQ ID NO: 570 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Acylated with a C14 fatty acyl group
  MOD_RES (16)..(16): Aminoisobutyric Acid
  MOD_RES (24)..(24): Pegylated
HXQGTFTSDKSKYLDXRRAQDFVCWLMNT

SEQ ID NO: 571 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Acylated with a C14 fatty acyl group via gamma-Glu-gamma-Glu spacer
  MOD_RES (16)..(16): Aminoisobutyric Acid
  MOD_RES (24)..(24): Pegylated
HXQGTFTSDKSKYLDXRRAQDFVCWLMNT

SEQ ID NO: 572 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C14 fatty acyl group via gamma-Glu-gamma-Glu spacer
  MOD_RES (16)..(16): Aminoisobutryic Acid
HXQGTFTSDKSKYLDXRRAQDFVQWLMNT

SEQ ID NO: 573 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C14 fatty acyl group via Ala-Ala spacer
  MOD_RES (16)..(16): Aminoisobutryic Acid
  MOD_RES (24)..(24): Pegylated
HXQGTFTSDKSKYLDXRRAQDFVCWLMNT

SEQ ID NO: 574 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C14 fatty acyl group via Ala-Ala spacer
  MOD_RES (16)..(16): Aminoisobutryic Acid
HXQGTFTSDKSKYLDXRRAQDFVQWLMNT

SEQ ID NO: 575 - protein, 29 aa, Artificial Sequence
  Synthetic peptide
  MISC_FEATURE: c-term amidation
  MOD_RES (2)..(2): Aminoisobutryic acid
  MOD_RES (10)..(10): Acylated with a C16 fatty acyl group via Ala-Ala spacer
  MOD_RES (16)..(16): Aminoisobutryic acid
  MOD_RES (24)..(24): Pegylated
HXQGTFTSDKSKYLDXRRAQDFVCWLMNT

SEQ ID NO: 576 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via gamma-Glu-gamma-Glu spacer
  MOD_RES (16)..(16): Aminoisobutryic Acid
  MOD_RES (24)..(24): Pegylated
HXQGTFTSDKSKYLDXRRAQDFVCWLMNT

SEQ ID NO: 577 - protein, 29 aa, Artificial Sequence
  Synthetic peptide
  MISC_FEATURE: c-term amidation
  MOD_RES (10)..(10): Acylated with a C16 fatty acyl group
HSQGTFTSDKSKYLDSRRAQDFVQWLMNT

SEQ ID NO: 578 - protein, 29 aa, Artificial Sequence
  Synthetic peptide
  MISC_FEATURE: c-term amidation
  MOD_RES (10)..(10): Acylated with a C16 fatty acyl group via gamma-Glu-gamma-Glu spacer
HSQGTFTSDKSKYLDSRRAQDFVQWLMNT

SEQ ID NO: 579 - protein, 29 aa, Artificial Sequence
  Synthetic peptide
  MISC_FEATURE: AA-C16 Glucagon Amide
  MISC_FEATURE: c-term amidation
  MOD_RES (10)..(10): Acylated with a C16 fatty acyl group via Ala-Ala spacer
HSQGTFTSDKSKYLDSRRAQDFVQWLMNT

SEQ ID NO: 580 - protein, 29 aa, Artificial Sequence
  Synthetic peptide
  MISC_FEATURE: Chimera 2, AIB2, Lys10, Cys24-PEG
  MISC_FEATURE: c-term amidation
  MOD_RES (2)..(2): Aminoisobutryic Acid
  MOD_RES (24)..(24): Pegylated
HXQGTFTSDKSKYLDEQAAKEFICWLMNT

SEQ ID NO: 581 - protein, 30 aa, Artificial Sequence
  Synthetic peptide
  MISC_FEATURE: Peptide dS2E16K20K30-C14 Gluc Amide
  MISC_FEATURE: c-term amidation
  MOD_RES (2)..(2): Xaa is d-Ser
  MOD_RES (30)..(30): Acylated with a C14 fatty acyl group
HXQGTFTSDYSKYLDERRAKDFVQWLMNTK

SEQ ID NO: 582 - protein, 29 aa, Artificial Sequence
  Synthetic peptide
  MISC_FEATURE: Peptide dS2K10(C14)E16K20-Gluc Amide
  MISC_FEATURE: c-term amidation
  MOD_RES (2)..(2): Xaa is d-Ser
  MOD_RES (10)..(10): Acylated with a C14 fatty acyl group
HXQGTFTSDKSKYLDERRAKDFVQWLMNT

SEQ ID NO: 583 - protein, 30 aa, Artificial Sequence; identical to SEQ ID NO: 581
  Synthetic peptide
  MISC_FEATURE: Peptide dS2E16K20K30-C16 Gluc Amide
  MISC_FEATURE: c-term amidation
  MOD_RES (2)..(2): Xaa is d-Ser
  MOD_RES (30)..(30): Acylated with a C16 fatty acyl group

SEQ ID NO: 584 - protein, 29 aa, Artificial Sequence
  Synthetic peptide
  MISC_FEATURE: Peptide dS2K10(C16)E16K20-Gluc Amide
  MISC_FEATURE: c-term amidation
  MOD_RES (2)..(2): Xaa is d-Ser
  MOD_RES (10)..(10): Acylated with a C16 fatty acyl group
HXQGTFTSDKSKYLDERRAKDFVQWLMNT

SEQ ID NO: 585 - protein, 29 aa, Artificial Sequence
  Synthetic peptide
  MISC_FEATURE: Peptide Chimera 2-AIB2-K10-acylated
  MISC_FEATURE: c-term amidation
  MOD_RES (2)..(2): Aminoisobutryic Acid
  MOD_RES (10)..(10): Acylated with a C18 fatty acyl group
  MOD_RES (24)..(24): Pegylated
HXQGTFTSDKSKYLDEQAAKEFICWLMNT

SEQ ID NO: 586 - protein, 30 aa, Artificial Sequence
  Synthetic peptide
  MISC_FEATURE: Peptide Chimera 2-AIB2-K30-acylated
  MISC_FEATURE: c-term amidation
  MOD_RES (2)..(2): Aminoisobutryic Acid
  MOD_RES (24)..(24): Pegylated
  MOD_RES (30)..(30): Acylated with a C18 fatty acyl group
HXQGTFTSDYSKYLDEQAAKEFICWLMNTK

SEQ ID NO: 587 - protein, 29 aa, Artificial Sequence
  Synthetic peptide
  MISC_FEATURE: c-term amidation
  MOD_RES (1)..(1): DMIA
XSQGTFTSDYSKYLDERRAKDFVCWLMNT

SEQ ID NO: 588 - protein, 29 aa, Artificial Sequence
  Synthetic peptide
  MISC_FEATURE: c-term amidation
  MOD_RES (1)..(1): DMIA
  MOD_RES (16)..(20): Lactam ring between side chains of amino acids at positions 16 and 20
XSQGTFTSDYSKYLDERRAKDFVCWLMNT

SEQ ID NO: 589 - protein, 29 aa, Artificial Sequence
  Synthetic peptide
  MISC_FEATURE: c-term amidation
  MOD_RES (2)..(2): Aminoisobutryic Acid
HXEGTFTSDYSKYLDEQAAKEFICWLMNT

SEQ ID NO: 590 - protein, 29 aa, Artificial Sequence
  Synthetic peptide
  MISC_FEATURE: c-term amidation
  MOD_RES (2)..(2): Aminoisobutryic Acid
  MOD_RES (24)..(24): Pegylated
HXEGTFTSDYSKYLDEQAAKEFICWLMNT

SEQ ID NO: 591 - protein, 29 aa, Artificial Sequence
  Synthetic peptide
  MOD_RES (3)..(3): Xaa is a Glutamine analog
  MOD_RES (27)..(27): Xaa is Norleucine
HSXGTFTSDYSKYLDTRRAAEFVAWLXDE

SEQ ID NO: 592 - protein, 29 aa, Artificial Sequence
  Synthetic peptide
  MOD_RES (3)..(3): Xaa is a Glutamine analog
  MOD_RES (16)..(16): Xaa is Aib
HSXGTFTSDYSKYLDXRRAADFVAWLMDE

SEQ ID NO: 593 - protein, 29 aa, Artificial Sequence
  Synthetic peptide
  MOD_RES (27)..(27): Xaa is Norleucine
HSQGTFTSDYSKYLDTRRAAEFVAWLXDE

SEQ ID NO: 594 - protein, 29 aa, Artificial Sequence
  Synthetic peptide
  MOD_RES (3)..(3): Xaa is Acetamidomethyl-cysteine
  MOD_RES (27)..(27): Xaa is Norleucine
HSXGTFTSDYSKYLDTRRAAEFVAWLXDE

SEQ ID NO: 595 - protein, 29 aa, Artificial Sequence
  Synthetic peptide
  MOD_RES (3)..(3): Xaa is Acetyldiaminobutanoic acid
  MOD_RES (27)..(27): Xaa is Norleucine
HSXGTFTSDYSKYLDTRRAAEFVAWLXDE

SEQ ID NO: 596 - protein, 29 aa, Artificial Sequence
  Synthetic peptide
  MOD_RES (3)..(3): Xaa is carbamoyldiaminopropanoic acid
  MOD_RES (27)..(27): Xaa is Norleucine
HSXGTFTSDYSKYLDTRRAAEFVAWLXDE

SEQ ID NO: 597 - protein, 29 aa, Artificial Sequence
  Synthetic peptide
  MOD_RES (3)..(3): Xaa is Methylglutamine
  MOD_RES (27)..(27): Xaa is Norleucine
HSXGTFTSDYSKYLDTRRAAEFVAWLXDE

SEQ ID NO: 598 - protein, 29 aa, Artificial Sequence
  Synthetic peptide
  MOD_RES (3)..(3): Xaa is Methionine sulfoxide
  MOD_RES (27)..(27): Xaa is Norleucine
HSXGTFTSDYSKYLDTRRAAEFVAWLXDE

SEQ ID NO: 599 - protein, 29 aa, Artificial Sequence
  Synthetic peptide
  MOD_RES (3)..(3): Acetylornithine
  MOD_RES (27)..(27): Xaa is Norleucine
HSXGTFTSDYSKYLDTRRAAEFVAWLXDE

SEQ ID NO: 600 - protein, 29 aa, Artificial Sequence
  Synthetic peptide
  MOD_RES (16)..(16): Xaa is Aminoisobutryic Acid
HSQGTFTSDYSKYLDXRRAADFVAWLMDE

SEQ ID NO: 601 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutyric Acid
HSXGTFTSDYSKYLDXRRAADFVAWLMDE

SEQ ID NO: 602 - protein, 29 aa, Artificial Sequence
  Synthetic peptide
  MOD_RES (3)..(3): Xaa is Methylglutamine
  MOD_RES (16)..(16): Xaa is Aminoisobutyric Acid
HSXGTFTSDYSKYLDXRRAADFVAWLMDE

SEQ ID NO: 603 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutryic Acid
HSXGTFTSDYSKYLDXRRAADFVAWLLDE

SEQ ID NO: 604 - protein, 39 aa, Artificial Sequence
  Synthetic peptide
  MISC_FEATURE: c-term amidation
  MOD_RES (3)..(3): Xaa is Acetyldiaminobutanoic acid
  MOD_RES (16)..(16): Xaa is Aminoisobutyric Acid
HSXGTFTSDYSKYLDXRRAADFVAWLLDTGPSSGAPPPS

SEQ ID NO: 605 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutryic Acid
HSXGTFTSDYSKYLDXRRASDFVSWLLDE

SEQ ID NO: 606 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutryic Acid
HSXGTFTSDYSKYLDXRRATDFVTWLLDE

SEQ ID NO: 607 - protein, 29 aa, Artificial Sequence
  Synthetic peptide
  MISC_FEATURE: c-term amidation
  MOD_RES (1)..(1): Xaa is Dmia
  MOD_RES (10)..(10): Covalently bound to a C14 fatty acyl group
  MOD_RES (16)..(20): Lactam ring between side chains of amino acids at positions 16 and 20
XSQGTFTSDKSKYLDERRAKDFVQWLMNT

SEQ ID NO: 608 - protein, 29 aa, Artificial Sequence
  Synthetic peptide
  MISC_FEATURE: c-term amidation
  MOD_RES (1)..(1): DMIA
  MOD_RES (10)..(10): Covalently bound to C16 fatty acyl group
  MOD_RES (16)..(20): Lactam ring between side chains of amino acids at positions 16 and 20
XSQGTFTSDKSKYLDERRAKDFVQWLMNT

SEQ ID NO: 609 - protein, 29 aa, Artificial Sequence
  Synthetic peptide
  MISC_FEATURE: c-term amidation
  MOD_RES (1)..(1): DMIA
  MOD_RES (10)..(10): Covalently bound to C18 fatty acyl group
  MOD_RES (16)..(20): Lactam ring between side chains of amino acids at positions 16 and 20
XSQGTFTSDKSKYLDERRAKDFVQWLMNT

SEQ ID NO: 610 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Covalently bound to C14 fatty acyl group
  MOD_RES (16)..(16): Aminoisobutryic Acid
HXQGTFTSDKSKYLDXRRAQDFVQWLMNT

SEQ ID NO: 611 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Covalently bound to C16 fatty acyl group
  MOD_RES (16)..(16): Aminoisobutryic Acid
HXQGTFTSDKSKYLDXRRAQDFVQWLMNT

SEQ ID NO: 612 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Covalently bound to C18 fatty acyl group
  MOD_RES (16)..(16): Aminoisobutryic Acid
HXQGTFTSDKSKYLDXRRAQDFVQWLMNT

SEQ ID NO: 613 - protein, 29 aa, Artificial Sequence
  Synthetic peptide
  MISC_FEATURE: c-term amidation
  MOD_RES (2)..(2): Xaa is d-Ser
  MOD_RES (10)..(10): Covalently bound to C14 fatty acyl group
HXQGTFTSDKSKYLDERRAKDFVQWLMNT

SEQ ID NO: 614 - protein, 29 aa, Artificial Sequence
  Synthetic peptide
  MISC_FEATURE: c-term amidation
  MOD_RES (2)..(2): Xaa is d-Ser
  MOD_RES (10)..(10): Covalently bound to C16 fatty acyl group
HXQGTFTSDKSKYLDERRAKDFVQWLMNT

SEQ ID NO: 615 - protein, 29 aa, Artificial Sequence
  Synthetic peptide
  MISC_FEATURE: c-term amidation
  MOD_RES (2)..(2): Xaa is d-Ser
  MOD_RES (10)..(10): Covalently bound to a C18 fatty acyl group
HXQGTFTSDKSKYLDERRAKDFVQWLMNT

SEQ ID NO: 616 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Covalently bound to a C14 fatty acyl group
  MOD_RES (16)..(16): Aminoisobutyric Acid
HXQGTFTSDKSKYLDXRRAQDFVCWLMNT

SEQ ID NO: 617 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Covalently bound to C14 fatty acyl group via gamma-Glu-gamma-Glu spacer
  MOD_RES (16)..(16): Aminoisobutryic Acid
HXQGTFTSDKSKYLDXRRAQDFVCWLMNT

SEQ ID NO: 618 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Covalently bound to C14 fatty acyl group via Ala-Ala spacer
  MOD_RES (16)..(16): Aminoisobutryic Acid
HXQGTFTSDKSKYLDXRRAQDFVCWLMNT

SEQ ID NO: 619 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Covalently bound to C16 fatty acyl group via di peptide spacer
  MOD_RES (16)..(16): Aminoisobutyric Acid
HXQGTFTSDKSKYLDXRRAQDFVCWLMNT

SEQ ID NO: 620 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Covelently bound to C16 fatty acyl group via Ala-Ala spacer
  MOD_RES (16)..(16): Aminoisobutyric Acid
HXQGTFTSDKSKYLDXRRAQDFVCWLMNT

SEQ ID NO: 621 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Covalently bound to C16 fatty acyl group
  MOD_RES (16)..(16): Aminoisobutyric Acid
HXQGTFTSDKSKYLDXRRAQDFVCWLMNT

SEQ ID NO: 622 - protein, 30 aa, Artificial Sequence
  Synthetic peptide
  MISC_FEATURE: c-term amidation
  MOD_RES (2)..(2): Aminoisobutyric Acid
  MOD_RES (10)..(10): Covalently bound to C16 fatty acyl group
  MOD_RES (16)..(16): Aminoisobutyric Acid
HXQGTFTSDKSKYLDXRRAQDFVCWLMNTK

SEQ ID NO: 623 - protein, 29 aa, Artificial Sequence
  Synthetic peptide
  MISC_FEATURE: beta-Ala-beta-Ala - C16 Glucagon Amide
  MISC_FEATURE: c-term amidation
  MISC_FEATURE (10)..(10): Acylated with a C16 fatty acyl group via beta-Ala-beta-Ala spacer
HSQGTFTSDKSKYLDSRRAQDFVQWLMNT

SEQ ID NO: 624 - protein, 29 aa, Artificial Sequence
  Synthetic peptide
  MISC_FEATURE: Chimera-2 Aib2C24Mal40KPEG
  MOD_RES (2)..(2): Xaa is Aib
  MOD_RES (24)..(24): Covalently bound to 40kDa PEG via thioether made by reaction of peptide with a maleimide-activated PEG
  MOD_RES (29)..(29): AMIDATION
HXQGTFTSDYSKYLDEQAAKEFICWLMNT

SEQ ID NO: 625 - protein, 29 aa, Artificial Sequence
  Synthetic peptide
  MISC_FEATURE: Chimera-2 Aib2E16K20lactamC24Mal40KPEG
  MOD_RES (2)..(2): Xaa is Aib
  MISC_FEATURE (16)..(20): Lactam ring between side chains of the amino acids at positions 16 and 20
  MOD_RES (24)..(24): Covalently bound to 40kDa PEG via thioether made by reaction of peptide with a maleimide-activated PEG
  MOD_RES (29)..(29): AMIDATION
HXQGTFTSDYSKYLDEQAAKEFICWLMNT

SEQ ID NO: 626 - protein, 29 aa, Artificial Sequence
  Synthetic peptide
  MISC_FEATURE: Glucagon Aib2E16K20lactamC24amideMal40KPEG
  MOD_RES (2)..(2): Xaa is Aib
  MISC_FEATURE (16)..(20): Lactam ring between side chains of amino acids at positions 16 and 20
  MOD_RES (24)..(24): Covalently bound to 40kDa PEG via thioether made by reaction of peptide with a maleimide-activated PEG
  MOD_RES (29)..(29): AMIDATION
HXQGTFTSDYSKYLDERRAKDFVCWLMNT

SEQ ID NO: 627 - skipped

SEQ ID NO: 628 - protein, 29 aa, Artificial Sequence
  Synthetic peptide
  MISC_FEATURE: Glucagon Dmia1E16K20lactamC24Mal40KPEG
  MOD_RES (1)..(1): Xaa is Dmia
  MISC_FEATURE (16)..(20): Lactam ring between side chains of amino acids at positions 16 and 20
  MOD_RES (24)..(24): Covalently bound to 40kDa PEG via thioether made by reaction of peptide with a maleimide-activated PEG
  MOD_RES (29)..(29): AMIDATION
XSQGTFTSDYSKYLDERRAKDFVCWLMNT

SEQ ID NO: 629 - protein, 29 aa, Artificial Sequence
  Synthetic peptide
  MISC_FEATURE: Glucagon Dmia1E16K20lactamC24Mal40KPEG
  MOD_RES (1)..(1): Xaa is Dmia
  MISC_FEATURE (16)..(20): Lactam ring between side chains of amino acids at positions 16 and 20
  MISC_FEATURE (24)..(24): Covalently bound to 40kDa PEG via thioether made by reaction of peptide with a maleimide-activated PEG
XSQGTFTSDYSKYLDERRAKDFVCWLMNT

SEQ ID NO: 630 - protein, 29 aa, Artificial Sequence
  Synthetic peptide
  MISC_FEATURE: Glucagon Dmia1E16K20lactamC24thioether40KPEG
  MOD_RES (1)..(1): Xaa is Dmia
  MISC_FEATURE (16)..(20): Lactam ring between side chains of amino acids at position 16 and 20
  MOD_RES (24)..(24): Covalently bound to 40kDa PEG via thioether made by reaction of peptide with haloacetyl-activated PEG
  MOD_RES (29)..(29): AMIDATION
XSQGTFTSDYSKYLDERRAKDFVCWLMNT

SEQ ID NO: 631 - protein, 29 aa, Artificial Sequence
  Synthetic peptide
  MISC_FEATURE: Chimera2 Aib2E3C24-Thioether40K PEG(NOF)
  MOD_RES (2)..(2): Xaa is Aib
  MOD_RES (24)..(24): Covalently bound to 40kDa PEG via thioether made by reaction of peptide with haloacetyl-activated PEG
  MOD_RES (29)..(29): AMIDATION
HXEGTFTSDYSKYLDEQAAKEFICWLMNT

SEQ ID NO: 632 - protein, 29 aa, Artificial Sequence
  Synthetic peptide
  MOD_RES (1)..(1): Xaa is Dmia
  MOD_RES (24)..(24): Covalently bound to 40kDa PEG
  MOD_RES (29)..(29): AMIDATION
XSEGTFTSDYSKYLEERRAKDFVCWLMNT

SEQ ID NO: 633 - protein, 29 aa, Artificial Sequence
  Synthetic peptide
  MISC_FEATURE: Glucagon Aib2Aib16C24K10(rErE-C16) C24PEG40K amide
  MOD_RES (2)..(2): Xaa is Aib
  MOD_RES (10)..(10): Covalently bound to C14 fatty acyl group via gamma-Glu-gamma-Glu spacer
  MOD_RES (16)..(16): Xaa is Aib
  MOD_RES (24)..(24): Covalently bound to 40kDa PEG via thioether made by reaction of peptide with haloacetyl-activated PEG
  MOD_RES (29)..(29): AMIDATION
HXQGTFTSDKSKYLDXRRAQDFVCWLMNT

SEQ ID NO: 634 - protein, 29 aa, Artificial Sequence
  Synthetic peptide
  MISC_FEATURE: Glucagon Aib2Aib16K10(AA-C14)C24PEG40K TE amide
  MOD_RES (2)..(2): Xaa is Aib
  MOD_RES (10)..(10): Covalently bound to C14 fatty acyl group via Ala-Ala spacer
  MOD_RES (16)..(16): Xaa is Aib
  MOD_RES (24)..(24): Covalently bound to 40kDa PEG via thioether made by reaction of peptide with haloacetyl-activated PEG
  MOD_RES (29)..(29): AMIDATION
HXQGTFTSDKSKYLDXRRAQDFVCWLMNT

SEQ ID NO: 635 - protein, 29 aa, Artificial Sequence
  Synthetic peptide
  MISC_FEATURE: Glucagon Aib2Aib16K10(AA-C16) amide
  MOD_RES (2)..(2): Xaa is Aib
  MOD_RES (10)..(10): Covalently bound to C16 fatty acyl group via Ala-Ala spacer
  MOD_RES (16)..(16): Xaa is Aib
  MOD_RES (29)..(29): AMIDATION
HXQGTFTSDKSKYLDXRRAQDFVQWLMNT

SEQ ID NO: 636 - protein, 29 aa, Artificial Sequence
  Synthetic peptide
  MISC_FEATURE: Glucagon Aib2Aib16K10(rErE-C16) amide
  MOD_RES (2)..(2): Xaa is Aib
  MOD_RES (10)..(10): Covalently bound to C16 fatty acyl group via gamma-Glu-gamma-Glu spacer
  MOD_RES (16)..(16): Xaa is Aib
  MOD_RES (29)..(29): AMIDATION
HXQGTFTSDKSKYLDXRRAQDFVQWLMNT

SEQ ID NO: 637 - protein, 29 aa, Artificial Sequence
  Synthetic peptide
  MOD_RES (2)..(2): Xaa is Aib
  MOD_RES (16)..(16): Xaa is Aib
  MOD_RES (29)..(29): AMIDATION
HXQGTFTSDYSKYLDXRRAQDFVQWLMNT

SEQ ID NO: 638 - DNA, 20 bp, Artificial Sequence
  Synthetic primer
caaggtccagggaggttgtg

SEQ ID NO: 639 - DNA, 24 bp, Artificial Sequence
  Synthetic primer
ccaaaggtaagctgtccataagga

SEQ ID NO: 640 - DNA, 22 bp, Artificial Sequence
  Synthetic primer
ctctcccaagagtcacatgtcc

SEQ ID NO: 641 - DNA, 22 bp, Artificial Sequence
  Synthetic primer
caataactcggtcccctacaac

SEQ ID NO: 642 - protein, 29 aa, Artificial Sequence
  Synthetic peptide
HSQGTFTSDYSKYLDSRRAQDFVQWLMDT

SEQ ID NO: 643 - protein, 29 aa, Artificial Sequence
  Synthetic peptide
  MISC_FEATURE: c-term amidation
  MOD_RES (2)..(2): Xaa is d-Ser
  MOD_RES (10)..(10): Acylated with a C16 fatty acyl group via gamma-Glu spacer
HXQGTFTSDKSKYLDEQAAKEFIAWLMNT

SEQ ID NO: 644 - protein, 29 aa, Artificial Sequence
  Synthetic peptide
  MISC_FEATURE: c-term amidation
  MOD_RES (2)..(2): Xaa is d-Ser
  MOD_RES (10)..(10): Acylated with a C16 fatty acyl group via gamma-Glu-gamma-Glu spacer
HXQGTFTSDKSKYLDEQAAKEFIAWLMNT

SEQ ID NO: 645 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via gamma-Glu spacer
HXQGTFTSDKSKYLDEQAAKEFIAWLMNT

SEQ ID NO: 646 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via gamma-Glu-gamma-Glu spacer
HXQGTFTSDKSKYLDEQAAKEFIAWLMNT

SEQ ID NO: 647 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group
HXEGTFTSDKSKYLDEQAAKEFIAWLMNT

SEQ ID NO: 648 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via gamma-Glu-gamma-Glu spacer
HXEGTFTSDKSKYLDEQAAKEFIAWLMNT

SEQ ID NO: 649 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via gamma-Glu spacer
HXQGTFISDKSKYLDEQAAKEFIAWLMNT

SEQ ID NO: 650 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via gamma-Glu-gamma-Glu spacer
HXQGTFISDKSKYLDEQAAKEFIAWLMNT

SEQ ID NO: 651 - protein, 29 aa, Artificial Sequence
  Synthetic peptide
  MISC_FEATURE: c-term amidation
  MOD_RES (1)..(1): Xaa is Dmia
  MOD_RES (10)..(10): Acylated with a C16 fatty acyl group via gamma-Glu spacer
  MISC_FEATURE (16)..(20): Lactam ring between side chains of amino acids at positions 16 and 20
XSQGTFTSDKSKYLDERRAKDFVQWLMNT

SEQ ID NO: 652 - protein, 29 aa, Artificial Sequence
  Synthetic peptide
  MISC_FEATURE: c-term amidation
  MOD_RES (1)..(1): Xaa is Dmia
  MOD_RES (10)..(10): Acylated with a C16 fatty acyl group via gamma-Glu-gamma-Glu spacer
  MISC_FEATURE (16)..(20): Lactam ring between side chains of amino acids at positions 16 and 20
XSQGTFTSDKSKYLDERRAKDFVQWLMNT

SEQ ID NO: 653 - protein, 29 aa, Artificial Sequence
  Synthetic peptide
  MISC_FEATURE: c-term amidation
  MOD_RES (1)..(1): Xaa is Dmia
  MISC_FEATURE (16)..(20): Lactam ring between side chains of amino acids at positions 16 and 20
  MOD_RES (29)..(29): Acylated with a C16 fatty acyl group via gamma-Glu spacer
XSQGTFTSDYSKYLDERRAKDFVQWLMNK

SEQ ID NO: 654 - protein, 29 aa, Artificial Sequence
  Synthetic peptide
  MISC_FEATURE: c-term amidation
  MOD_RES (1)..(1): Xaa is Dmia
  MISC_FEATURE (16)..(20): Lactam ring between side chains of amino acids at positions 16 and 20
  MOD_RES (29)..(29): Acylated with a C16 fatty acyl group via gamma-Glu-gamma-Glu spacer
XSQGTFTSDYSKYLDERRAKDFVQWLMNK

SEQ ID NO: 655 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via gamma-Glu-gamma-Glu spacer
  MOD_RES (16)..(16): Xaa is Aib
HXQGTFTSDKSKYLDXRAAQDFVQWLMDT

SEQ ID NO: 656 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via gamma-Glu spacer
  MOD_RES (16)..(16): Xaa is Aib
HXQGTFTSDKSKYLDXRAAQDFVQWLMDT

SEQ ID NO: 657 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via dipeptide spacer
  MOD_RES (16)..(16): Aminoisobutryic Acid
HXQGTFTSDKSKYLDXRRAQDFVQWLMNT

SEQ ID NO: 658 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Acylated with a C14 fatty acyl group via dipeptide spacer
  MOD_RES (16)..(16): Aminoisobutyric Acid
  MOD_RES (24)..(24): Pegylated
HXQGTFTSDKSKYLDXRRAQDFVCWLMNT

SEQ ID NO: 659 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C14 fatty acyl group via dipeptide spacer
  MOD_RES (16)..(16): Aminoisobutryic Acid
HXQGTFTSDKSKYLDXRRAQDFVQWLMNT

SEQ ID NO: 660 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via dipeptide spacer
  MOD_RES (16)..(16): Aminoisobutryic Acid
  MOD_RES (24)..(24): Pegylated
HXQGTFTSDKSKYLDXRRAQDFVCWLMNT

SEQ ID NO: 661 - protein, 29 aa, Artificial Sequence
  Synthetic peptide
  MISC_FEATURE: c-term amidation
  MOD_RES (10)..(10): Acylated with a C16 fatty acyl group via dipeptide spacer
HSQGTFTSDKSKYLDSRRAQDFVQWLMNT

SEQ ID NO: 662 - protein, 30 aa, Artificial Sequence; identical to SEQ ID NO: 581
  Synthetic peptide
  MISC_FEATURE: Peptide dS2E16K20K30-C14 Gluc Amide
  MISC_FEATURE: c-term amidation
  MOD_RES (2)..(2): D-serine, D-alanine, valine, amino n-butyric acid, glycine, N-methyl serine, aminoisobutyric acid
  MOD_RES (30)..(30): Acylated with a C14 fatty acyl group

SEQ ID NO: 663 - protein, 29 aa, Artificial Sequence
  Synthetic peptide
  MISC_FEATURE: Peptide dS2K10(C14)E16K20-Gluc Amide
  MISC_FEATURE: c-term amidation
  MOD_RES (2)..(2): D-serine, D-alanine, valine, amino n-butyric acid, glycine, N-methyl serine, aminoisobutyric acid
  MOD_RES (10)..(10): Acylated with a C14 fatty acyl group
HXQGTFTSDKSKYLDERRAKDFVQWLMNT

SEQ ID NO: 664 - protein, 30 aa, Artificial Sequence; identical to SEQ ID NO: 581
  Synthetic peptide
  MISC_FEATURE: Peptide dS2E16K20K30-C16 Gluc Amide
  MISC_FEATURE: c-term amidation
  MOD_RES (2)..(2): D-serine, D-alanine, valine, amino n-butyric acid, glycine, N-methyl serine, aminoisobutyric acid
  MOD_RES (30)..(30): Acylated with a C16 fatty acyl group

SEQ ID NO: 665 - protein, 29 aa, Artificial Sequence
  Synthetic peptide
  MISC_FEATURE: Peptide dS2K10(C16)E16K20-Gluc Amide
  MISC_FEATURE: c-term amidation
  MOD_RES (2)..(2): D-serine, D-alanine, valine, amino n-butyric acid, glycine, N-methyl serine, aminoisobutyric acid
  MOD_RES (10)..(10): Acylated with a C16 fatty acyl group
HXQGTFTSDKSKYLDERRAKDFVQWLMNT

SEQ ID NO: 666 - protein, 29 aa, Artificial Sequence
  Synthetic peptide
  MISC_FEATURE: c-term amidation
  MOD_RES (2)..(2): D-serine, D-alanine, valine, amino n-butyric acid, glycine, N-methyl serine, aminoisobutyric acid
  MOD_RES (10)..(10): Covalently bound to C14 fatty acyl group
HXQGTFTSDKSKYLDERRAKDFVQWLMNT

SEQ ID NO: 667 - protein, 29 aa, Artificial Sequence
  Synthetic peptide
  MISC_FEATURE: c-term amidation
  MOD_RES (2)..(2): D-serine, D-alanine, valine, amino n-butyric acid, glycine, N-methyl serine, aminoisobutyric acid
  MOD_RES (10)..(10): Covalently bound to C16 fatty acyl group
HXQGTFTSDKSKYLDERRAKDFVQWLMNT

SEQ ID NO: 668 - protein, 29 aa, Artificial Sequence
  Synthetic peptide
  MISC_FEATURE: c-term amidation
  MOD_RES (2)..(2): D-serine, D-alanine, valine, amino n-butyric acid, glycine, N-methyl serine, aminoisobutyric acid
  MOD_RES (10)..(10): Covalently bound to a C18 fatty acyl group
HXQGTFTSDKSKYLDERRAKDFVQWLMNT

SEQ ID NO: 669 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Covalently bound to C14 fatty acyl group via dipeptide spacer
  MOD_RES (16)..(16): Aminoisobutryic Acid
HXQGTFTSDKSKYLDXRRAQDFVCWLMNT

SEQ ID NO: 670 - protein, 29 aa, Artificial Sequence
  Synthetic peptide
  MISC_FEATURE: Glucagon Aib2Aib16C24K10(rErE-C16) C24PEG40K amide
  MOD_RES (2)..(2): Xaa is Aib
  MOD_RES (10)..(10): Covalently bound to C14 fatty acyl group via dipeptide spacer
  MOD_RES (16)..(16): Xaa is Aib
  MOD_RES (24)..(24): Covalently bound to 40kDa PEG via thioether made by reaction of peptide with haloacetyl-activated PEG
  MOD_RES (29)..(29): AMIDATION
HXQGTFTSDKSKYLDXRRAQDFVCWLMNT

SEQ ID NO: 671 - protein, 29 aa, Artificial Sequence
  Synthetic peptide
  MISC_FEATURE: Glucagon Aib2Aib16K10(rErE-C16) amide
  MOD_RES (2)..(2): Xaa is Aib
  MOD_RES (10)..(10): Covalently bound to C16 fatty acyl group via dipeptide spacer
  MOD_RES (16)..(16): Xaa is Aib
  MOD_RES (29)..(29): AMIDATION
HXQGTFTSDKSKYLDXRRAQDFVQWLMNT

SEQ ID NO: 672 - protein, 29 aa, Artificial Sequence
  Synthetic peptide
  MISC_FEATURE: c-term amidation
  MOD_RES (2)..(2): D-serine, D-alanine, valine, amino n-butyric acid, glycine, N-methyl serine, aminoisobutyric acid
  MOD_RES (10)..(10): Acylated with a C16 fatty acyl group via acidic amino acid spacer
HXQGTFTSDKSKYLDEQAAKEFIAWLMNT

SEQ ID NO: 673 - protein, 29 aa, Artificial Sequence
  Synthetic peptide
  MISC_FEATURE: c-term amidation
  MOD_RES (2)..(2): D-serine, D-alanine, valine, amino n-butyric acid, glycine, N-methyl serine, aminoisobutyric acid
  MOD_RES (10)..(10): Acylated with a C16 fatty acyl group via dipeptide spacer
HXQGTFTSDKSKYLDEQAAKEFIAWLMNT

SEQ ID NO: 674 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via acidic amino acid spacer
HXQGTFTSDKSKYLDEQAAKEFIAWLMNT

SEQ ID NO: 675 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via dipeptide spacer
HXQGTFTSDKSKYLDEQAAKEFIAWLMNT

SEQ ID NO: 676 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via dipeptide spacer
HXEGTFTSDKSKYLDEQAAKEFIAWLMNT

SEQ ID NO: 677 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via acidic amino acid spacer
HXQGTFISDKSKYLDEQAAKEFIAWLMNT

SEQ ID NO: 678 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via dipeptide spacer
HXQGTFISDKSKYLDEQAAKEFIAWLMNT

SEQ ID NO: 679 - protein, 29 aa, Artificial Sequence
  Synthetic peptide
  MISC_FEATURE: c-term amidation
  MOD_RES (1)..(1): Xaa is Dmia
  MOD_RES (10)..(10): Acylated with a C16 fatty acyl group via acidic amino acid spacer
  MISC_FEATURE (16)..(20): Lactam ring between side chains of amino acids at positions 16 and 20
XSQGTFTSDKSKYLDERRAKDFVQWLMNT

SEQ ID NO: 680 - protein, 29 aa, Artificial Sequence
  Synthetic peptide
  MISC_FEATURE: c-term amidation
  MOD_RES (1)..(1): Xaa is Dmia
  MOD_RES (10)..(10): Acylated with a C16 fatty acyl group via dipeptide spacer
  MISC_FEATURE (16)..(20): Lactam ring between side chains of amino acids at positions 16 and 20
XSQGTFTSDKSKYLDERRAKDFVQWLMNT

SEQ ID NO: 681 - protein, 29 aa, Artificial Sequence
  Synthetic peptide
  MISC_FEATURE: c-term amidation
  MOD_RES (1)..(1): Xaa is Dmia
  MISC_FEATURE (16)..(20): Lactam ring between side chains of amino acids at positions 16 and 20
  MOD_RES (29)..(29): Acylated with a C16 fatty acyl group via acidic amino acid spacer
XSQGTFTSDYSKYLDERRAKDFVQWLMNK

SEQ ID NO: 682 - protein, 29 aa, Artificial Sequence
  Synthetic peptide
  MISC_FEATURE: c-term amidation
  MOD_RES (1)..(1): Xaa is Dmia
  MISC_FEATURE (16)..(20): Lactam ring between side chains of amino acids at positions 16 and 20
  MOD_RES (29)..(29): Acylated with a C16 fatty acyl group via dipeptide spacer
XSQGTFTSDYSKYLDERRAKDFVQWLMNK

SEQ ID NO: 683 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via dipeptide spacer
  MOD_RES (16)..(16): Xaa is Aib
HXQGTFTSDKSKYLDXRAAQDFVQWLMDT

SEQ ID NO: 684 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via acidic amino acid spacer
  MOD_RES (16)..(16): Xaa is Aib
HXQGTFTSDKSKYLDXRAAQDFVQWLMDT

SEQ ID NO: 685 - protein, 29 aa, Artificial Sequence
  Synthetic Polypeptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDERRAQDFVQWLMNT

SEQ ID NO: 686 - protein, 29 aa, Artificial Sequence
  Synthetic Polypeptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDERRAKDFVQWLMNT

SEQ ID NO: 687 - protein, 29 aa, Artificial Sequence
  Synthetic Polypeptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDKRRAEDFVQWLMNT

SEQ ID NO: 688 - protein, 29 aa, Artificial Sequence
  Synthetic Polypeptide
  MOD_RES (1)..(1): (Des-amino)His
  MISC_FEATURE (29)..(29): c-term amidation
XSQGTFTSDYSKYLDERAAKDFVQWLMNT

SEQ ID NO: 689 - protein, 29 aa, Artificial Sequence
  Synthetic Polypeptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDERAAKDFVQWLMNT

SEQ ID NO: 690 - protein, 29 aa, Artificial Sequence
  Synthetic Polypeptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDERAAQDFVQWLMNT

SEQ ID NO: 691 - protein, 29 aa, Artificial Sequence
  Synthetic Polypeptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDERAAKDFVQWLMNT

SEQ ID NO: 692 - protein, 29 aa, Artificial Sequence
  Synthetic Polypeptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDKRAAEDFVQWLMNT

SEQ ID NO: 693 - protein, 29 aa, Artificial Sequence
  Synthetic Polypeptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDEQAAKEFIAWLMNT

SEQ ID NO: 694-698 - skipped (5 entries)

SEQ ID NO: 699 - protein, 29 aa, Artificial Sequence
  Glucagon analog
  MOD_RES (29)..(29): C-terminal amidation
HSQGTFTSDYSKYLDERRAQDFVQWLMNT

SEQ ID NO: 700 - protein, 31 aa, Artificial Sequence
  GLP-1 analog
HAEGTFTSDVSSYLEEQAAREFIAWLVRGRG

SEQ ID NO: 701 - protein, 29 aa, Homo sapiens
  MOD_RES (29)..(29): C-terminal amidation
HSQGTFTSDYSKYLDSRRAQDFVQWLMNT

SEQ ID NO: 702 - protein, 24 aa, Artificial Sequence
  Glucagon analog
  MOD_RES (1)..(1): N-terminal amino group replaced with hydroxy group
FTSDYSKYLDSRRAQDFVQWLMNT

SEQ ID NO: 703 - protein, 31 aa, Homo sapiens
HAEGTFTSDVSSYLEGQAAKEFIAWLVKGRG

SEQ ID NO: 704 - protein, 30 aa, Homo sapiens
  MOD_RES (30)..(30): AMIDATION
HAEGTFTSDVSSYLEGQAAKEFIAWLVKGR

SEQ ID NO: 705 - protein, 28 aa, Homo sapiens
HGEGTFTSDLSKQMEEAVRLFIEWLKNG

SEQ ID NO: 706 - protein, 37 aa, Homo sapiens
HSQGTFTSDYSKYLDSRRAQDFVQWLMDTKRNRNNIA

SEQ ID NO: 707 - protein, 42 aa, Homo sapiens
YAEGTFISDYSIAMDKIHQQDFVNWLLAQKGKKNDWKHNITQ

SEQ ID NO: 708 - protein, 33 aa, Homo sapiens
HADGSFSDEMNTILDNLAARDFINWLIQTKITD

SEQ ID NO: 709 - protein, 49 aa, Homo sapiens
YLYQWLGAPVPYPDPLEPRREVCELNPDCDELADHIGFQEAYRRFYGPV

SEQ ID NO: 710 - protein, 10 aa, Artificial Sequence
  peptide fragment representing the carboxy terminal 10 amino acids of Exendin-4
GPSSGAPPPS

SEQ ID NO: 711 - protein, 10 aa, Artificial Sequence
  peptide fragment representing the carboxy terminal 10 amino acids of Exendin-4
  MOD_RES (10)..(10): AMIDATION
GPSSGAPPPS

SEQ ID NO: 712 - protein, 11 aa, Artificial Sequence
  peptide fragment representing the carboxy terminal 10 amino acids of Exendin-4
  MOD_RES (11)..(11): Pegylation
GPSSGAPPPSC

SEQ ID NO: 713 - protein, 13 aa, Artificial Sequence
  peptide fragment representing the carboxy terminal 13 amino acids of GIP peptide
KGKKNDWKHNITQ

SEQ ID NO: 714 - protein, 8 aa, Artificial Sequence
  peptide fragment representing the carboxy terminal 8 amino acids of oxyntomodulin
KRNRNNIA

SEQ ID NO: 715 - protein, 6 aa, Artificial Sequence
  Glucagon analogue
  MOD_RES (6)..(6): C-terminal amide
HTRGTF

SEQ ID NO: 716 - protein, 6 aa, Artificial Sequence
  glucagon analogue
  MOD_RES (1)..(1): d-histidine
  MOD_RES (2)..(2): d-threonine
  MOD_RES (3)..(3): d-arginine
  MOD_RES (5)..(5): d-threonine
  MOD_RES (6)..(6): d-phenylalanine
  MOD_RES (6)..(6): C-terminal amidation
XXXGXX

SEQ ID NO: 717 - protein, 30 aa, Artificial Sequence
  glucagon analogue
  MOD_RES (24)..(24): pegylation
HAEGTFTSDVSSYLEGQAAKEFICWLVKGR

SEQ ID NO: 718 - protein, 39 aa, Heloderma suspectum
HGEGTFTSDLSKQMEEEAVRLFIEWLKNGGPSSGAPPPS

SEQ ID NO: 719 - protein, 29 aa, Homo sapiens
YADAIFTNSYRKVLGQLSARKLLQDIMSR

SEQ ID NO: 720 - protein, 28 aa, Homo sapiens
  MOD_RES (28)..(28): AMIDATION
HSDAVFTDNYTRLRKQMAVKKYLNSILN

SEQ ID NO: 721 - protein, 27 aa, Homo sapiens
HSDGIFTDSYSRYRKQMAVKKYLAAVL

SEQ ID NO: 722 - protein, 27 aa, Homo sapiens
  MOD_RES (27)..(27): AMIDATION
HADGVFTSDFSKLLGQLSAKKYLESLM

SEQ ID NO: 723 - protein, 27 aa, Homo sapiens
  MOD_RES (27)..(27): AMIDATION
HSDGTFTSELSRLREGARLQRLLQGLV

SEQ ID NO: 724 - protein, 30 aa, Artificial Sequence
  Synthetic peptide
  MOD_RES (2)..(2): Xaa is AIB
  MOD_RES (24)..(24): Cys residue linked to 40kDa PEG via maleimide
  MOD_RES (30)..(30): C-terminal amidation
HXQGTFTSDYSKYLDEQAAKEFICWLMNTN

SEQ ID NO: 725 - protein, 29 aa, Artificial Sequence
  Synthetic peptide
  MOD_RES (2)..(2): Xaa is AIB
  MISC_FEATURE (24)..(24): Covalently bound to 40K PEG via thioether
  MOD_RES (29)..(29): AMIDATION
HXEGTFTSDYSKYLDEQAAKEFICWLMNT

SEQ ID NO: 726 - protein, 31 aa, Artificial Sequence
  Synthetic peptide
  MOD_RES (1)..(1): d-lysine
  MOD_RES (2)..(2): Sarcosine (N-methyl glycine)
  MOD_RES (4)..(4): Xaa is AIB
  MOD_RES (24)..(24): Covalently bound to 40kDa PEG via thioether
  MOD_RES (31)..(31): AMIDATION
KGHXEGTFTSDYSKYLDEQAAKEFICWLMNT

SEQ ID NO: 727 - protein, 31 aa, Artificial Sequence; identical to SEQ ID NO: 726
  Synthetic peptide
  MOD_RES (1)..(1): d-lysine
  MOD_RES (2)..(2): N-hexyl-glycine
  MOD_RES (4)..(4): Xaa is AIB
  MOD_RES (24)..(24): Covalently bound to 40kDa PEG via maleimide
  MOD_RES (31)..(31): AMIDATION

SEQ ID NO: 728 - protein, 31 aa, Artificial Sequence
  Synthetic peptide
  MOD_RES (1)..(1): d-lysine
  MOD_RES (2)..(2): N-methyl phenylalanine
  MOD_RES (4)..(4): Xaa is AIB
  MOD_RES (24)..(24): Covalently bound to 40kDa PEG via thioether
  MOD_RES (31)..(31): AMIDATION
KFHXEGTFTSDYSKYLDEQAAKEFICWLMNT

SEQ ID NO: 729 - protein, 29 aa, Artificial Sequence
  Synthetic peptide
  MOD_RES (2)..(2): Xaa is AIB
  MOD_RES (24)..(24): Covalently bound to 40 kDa PEG via maleimide
HXEGTFTSDYSKYLDEQAAKEFICWLMNT

SEQ ID NO: 730 - protein, 29 aa, Artificial Sequence
  Synthetic peptide
  MOD_RES (1)..(1): Xaa is DMIA
  MISC_FEATURE (16)..(20): Lactam ring between side chains of amino acids
  MOD_RES (24)..(24): Covalently bound to 40kDa PEG via maleimide
  MOD_RES (29)..(29): C-terminal amidation
XSQGTFTSDKSKYLDERRAKDFVCWLMNT

SEQ ID NO: 731 - protein, 30 aa, Artificial Sequence
  Synthetic peptide
  MOD_RES (30)..(30): C-terminal amidation
HSQGTFTSDYSKYLDEQAAKEFIAWLMNTN

SEQ ID NO: 732 - protein, 8 aa, Artificial Sequence
  Synthetic peptide
  MOD_RES (1)..(1): Xaa is Phe, hydroxyl-Phe, Gly, hydroxyl-Gly, Ala, Cys, Ser, Lys, Glu, dehydro-Val, Pro, d-Pro, AIB, 1-aminocyclohexanecarboxylic acid, 1-aminocyclopropanecarboxylic acid, N-Me-AIB, alpha-alpha-diethyl-Gly, hydroxyl-AIB, or d-Lys
  MOD_RES (2)..(2): Xaa is Pro, d-Pro, N-methyl-Gly, N-hexyl-Gly, Azetidine-2-carboxylic acid, N-methyl-Ala, or N-methyl-Phe
  MOD_RES (3)..(3): Xaa is His, d-His, Ala, or N-methyl-His
  MOD_RES (8)..(8): C-terminal amidation
XXXSRGTF

SEQ ID NO: 733 - protein, 31 aa, Artificial Sequence
  Synthetic peptide
  MOD_RES (1)..(1): d-Lys
  MOD_RES (2)..(2): Xaa is Sar
  MOD_RES (4)..(4): Xaa is AIB
  MOD_RES (26)..(26): Covalently bound to PEG via 40kDa maleimide
KXHXEGTFTSDYSKYLDEQAAKEFICWLMNT

SEQ ID NO: 734 - protein, 32 aa, Artificial Sequence
  Synthetic peptide
  MOD_RES (1)..(1): d-Lys
  MOD_RES (2)..(2): Xaa is Sar
  MOD_RES (4)..(4): Xaa is AIB
  MOD_RES (26)..(26): Cys residue linked to 40kDa PEG via maleimide
  MOD_RES (32)..(32): C-terminal amidation
KXHXQGTFTSDYSKYLDEQAAKEFICWLMNTN

SEQ ID NO: 735 - protein, 31 aa, Artificial Sequence
  Synthetic peptide
  MOD_RES (1)..(1): d-Lys
  MOD_RES (2)..(2): Xaa is Sar
  MOD_RES (3)..(3): Xaa is DMIA
  MISC_FEATURE (18)..(22): Lactam ring between side chains of amino acids
  MOD_RES (26)..(26): Covalently bound to 40kDa PEG via maleimide
  MOD_RES (31)..(31): C-terminal amidation
KXXSQGTFTSDKSKYLDERRAKDFVCWLMNT

SEQ ID NO: 736 - protein, 31 aa, Artificial Sequence; identical to SEQ ID NO: 726
  Synthetic peptide
  MOD_RES (1)..(1): d-Lys
  MOD_RES (2)..(2): N-hexyl-Gly
  MOD_RES (4)..(4): Xaa is AIB
  MISC_FEATURE (26)..(26): Covalently bound to 40K PEG via thioether
  MOD_RES (31)..(31): AMIDATION

SEQ ID NO: 737 - protein, 32 aa, Artificial Sequence
  Synthetic peptide
  MOD_RES (1)..(1): d-Lys
  MOD_RES (2)..(2): N-hexyl-Gly
  MOD_RES (4)..(4): Xaa is AIB
  MOD_RES (26)..(26): Cys residue linked to 40kDa PEG via maleimide
  MOD_RES (32)..(32): C-terminal amidation
KGHXQGTFTSDYSKYLDEQAAKEFICWLMNTN

SEQ ID NO: 738 - protein, 31 aa, Artificial Sequence
  Synthetic peptide
  MOD_RES (1)..(1): d-Lys
  MOD_RES (2)..(2): N-hexyl-Gly
  MOD_RES (3)..(3): Xaa is DMIA
  MISC_FEATURE (18)..(22): Lactam ring between side chains of amino acids
  MOD_RES (26)..(26): Covalently bound to 40kDa PEG via maleimide
  MOD_RES (31)..(31): C-terminal amidation
KGXSQGTFTSDKSKYLDERRAKDFVCWLMNT

SEQ ID NO: 739 - protein, 31 aa, Artificial Sequence; identical to SEQ ID NO: 728
  Synthetic peptide
  MOD_RES (1)..(1): d-Lys
  MOD_RES (2)..(2): N-methyl-Phe
  MOD_RES (4)..(4): Xaa is AIB
  MOD_RES (26)..(26): Covalently bound to 40kDa PEG via maleimide

SEQ ID NO: 740 - protein, 32 aa, Artificial Sequence
  Synthetic peptide
  MOD_RES (1)..(1): d-Lys
  MOD_RES (2)..(2): N-methyl-Phe
  MOD_RES (4)..(4): Xaa is AIB
  MOD_RES (26)..(26): Cys residue linked to 40kDa PEG via maleimide
  MOD_RES (32)..(32): C-terminal amidation
KFHXQGTFTSDYSKYLDEQAAKEFICWLMNTN

SEQ ID NO: 741 - protein, 31 aa, Artificial Sequence
  Synthetic peptide
  MOD_RES (1)..(1): d-Lys
  MOD_RES (2)..(2): N-methyl-Phe
  MOD_RES (3)..(3): Xaa is DMIA
  MISC_FEATURE (18)..(22): Lactam ring between side chains of amino acids
  MOD_RES (26)..(26): Covalently bound to 40kDa PEG via maleimide
  MOD_RES (31)..(31): C-terminal amidation
KFXSQGTFTSDKSKYLDERRAKDFVCWLMNT

SEQ ID NO: 742 - protein, 29 aa, Artificial Sequence
  Synthetic peptide
  MOD_RES (2)..(2): Xaa is AIB
  MOD_RES (24)..(24): Pegylated
  MOD_RES (29)..(29): C-terminal amidation
HXEGTFTSDYSKYLDEQAAKEFICWLMNT

SEQ ID NO: 743 - protein, 29 aa, Artificial Sequence
  Synthetic peptide
  MOD_RES (2)..(2): Xaa is AIB
  MOD_RES (10)..(10): Acylated with fatty acyl group
  MOD_RES (16)..(16): Xaa is AIB
  MOD_RES (29)..(29): C-terminal amidation
HXQGTFTSDKSKYLDXRAAQDFVQWLMDT

SEQ ID NO: 744 - protein, 40 aa, Artificial Sequence
  Synthetic peptide
  MOD_RES (2)..(2): Xaa is AIB
  MOD_RES (40)..(40): C-terminal amidation
HXEGTFTSDVSSYLEEQAAKEFIAWLVKGGPSSGAPPPSK

SEQ ID NO: 745 - protein, 29 aa, Artificial Sequence
  Synthetic peptide
  MOD_RES (1)..(1): Xaa is Dmia
  MISC_FEATURE (16)..(20): Lactam ring between side chains of amino acids at positions 16 and 20
  MOD_RES (24)..(24): Pegylated
  MOD_RES (29)..(29): C-terminal amidation
XSQGTFTSDYSKYLDERRAKDFVCWLMNT

SEQ ID NO: 746 - protein, 29 aa, Artificial Sequence
  Synthetic peptide
  MOD_RES (2)..(2): d-Ser
  MISC_FEATURE (16)..(20): Lactam ring between side chains of amino acids at positions 16 and 20
  MOD_RES (24)..(24): Pegylated
  MOD_RES (29)..(29): C-terminal amidation
HSQGTFTSDYSLYLDERAAKDFVCWLLDT

SEQ ID NO: 747 - protein, 29 aa, Artificial Sequence
  Synthetic peptide
  MOD_RES (2)..(2): Xaa is AIB
  MOD_RES (16)..(16): Xaa is AIB
  MOD_RES (20)..(20): Xaa is AIB
  MOD_RES (24)..(24): Pegylated
  MOD_RES (29)..(29): C-terminal amidation
HXQGTFTSDYSKYLDXKRAXEFVCWLLDT

SEQ ID NO: 748 - protein, 29 aa, Artificial Sequence
  Synthetic peptide
  MOD_RES (2)..(2): Xaa is AIB
  MOD_RES (10)..(10): Acylated with fatty acyl group via dipeptide spacer
  MOD_RES (16)..(16): Xaa is AIB
  MOD_RES (29)..(29): C-terminal amidation
HXQGTFTSDKSKYLDXRAAQDFVQWLMDT

SEQ ID NO: 749 - protein, 29 aa, Artificial Sequence
  Synthetic peptide
  MOD_RES (2)..(2): Xaa is AIB
  MOD_RES (10)..(10): Acylated with fatty acyl group via acidic amino acid spacer
  MOD_RES (16)..(16): Xaa is AIB
  MOD_RES (29)..(29): C-terminal amidation
HXQGTFTSDKSKYLDXRAAQDFVQWLMDT

SEQ ID NO: 750 - protein, 29 aa, Artificial Sequence
  Synthetic peptide
  MOD_RES (2)..(2): d-Ser
  MOD_RES (10)..(10): Acylated with fatty acyl group via dipeptide spacer
  MOD_RES (16)..(16): Xaa is AIB
  MOD_RES (29)..(29): C-terminal amidation
HSQGTFTSDKSKYLDXRAAQDFVQWLMDT

SEQ ID NO: 751 - protein, 29 aa, Artificial Sequence
  Synthetic peptide
  MOD_RES (2)..(2): Xaa is AIB
  MOD_RES (10)..(10): Acylated with fatty acyl group via dipeptide spacer
  MOD_RES (16)..(16): Xaa is AIB
  MOD_RES (29)..(29): C-terminal amidation
HXQGTFTSDKSKYLDXRAAQDFVQWLLDT

SEQ ID NO: 752 - protein, 29 aa, Artificial Sequence
  Synthetic peptide
  MOD_RES (2)..(2): Xaa is AIB
  MOD_RES (10)..(10): Acylated with fatty acyl group via dipeptide spacer
  MOD_RES (29)..(29): C-terminal amidation
HXQGTFTSDKSKYLDERAAQDFVQWLMDT

SEQ ID NO: 753 - protein, 29 aa, Artificial Sequence
  Synthetic peptide
  MOD_RES (2)..(2): Xaa is AIB
  MOD_RES (10)..(10): Acylated with fatty acyl group via dipeptide spacer
  MOD_RES (16)..(16): Xaa is AIB
  MOD_RES (29)..(29): C-terminal amidation
HXQGTFTSDKSKYLEXRAAQDFVQWLMDT

SEQ ID NO: 754 - protein, 29 aa, Artificial Sequence
  Synthetic peptide
  MOD_RES (2)..(2): d-Ser
  MOD_RES (10)..(10): Acylated with fatty acyl group via acidic amino acid spacer
  MOD_RES (29)..(29): C-terminal amidation
HSQGTFTSDKSKYLDERAAQDFVQWLLDT

SEQ ID NO: 755 - protein, 29 aa, Artificial Sequence
  Synthetic peptide
  MOD_RES (2)..(2): Xaa is AIB
  MOD_RES (10)..(10): Acylated with fatty acyl group via acidic amino acid spacer
  MOD_RES (29)..(29): C-terminal amidation
HXQGTFTSDKSKYLDEQAAKEFIAWLLDT

SEQ ID NO: 756 - protein, 40 aa, Artificial Sequence
  Synthetic polypeptide
  MOD_RES (2)..(2): Xaa is Aib
  MOD_RES (20)..(20): Xaa is Aib
  MOD_RES (40)..(40): C-terminal amidation
YXEGTFTSDYSIYLDKQAAXEFVNWLLAGGPSSGAPPPSK

SEQ ID NO: 757 - protein, 39 aa, Artificial Sequence
  Synthetic polypeptide
  MOD_RES (2)..(2): Xaa is Aib
  MOD_RES (20)..(20): Xaa is Aib
  MOD_RES (39)..(39): C-terminal amidation
YXEGTFTSDYSIYLDKQAAXEFVNWLLAGGPSSGAPPPS

SEQ ID NO: 758 - protein, 39 aa, Artificial Sequence
  Synthetic polypeptide
  MOD_RES (2)..(2): Xaa is Aib
  MOD_RES (10)..(10): Acylated with fatty acyl group via dipeptide spacer
  MOD_RES (20)..(20): Xaa is AIB
  MOD_RES (39)..(39): C-terminal amidation
YXEGTFTSDKSIYLDKQAAXEFVNWLLAGGPSSGAPPPS

SEQ ID NO: 759 - protein, 40 aa, Artificial Sequence
  Synthetic polypeptide
  MOD_RES (2)..(2): Xaa is AIB
  MOD_RES (20)..(20): Xaa is AIB
  MOD_RES (24)..(24): Pegylated
  MOD_RES (40)..(40): C-terminal amidation
YXEGTFTSDYSIYLDKQAAXEFVCWLLAGGPSSGAPPPSK

SEQ ID NO: 760 - protein, 40 aa, Artificial Sequence
  Synthetic polypeptide
  MOD_RES (2)..(2): Xaa is AIB
  MOD_RES (20)..(20): Xaa is AIB
  MOD_RES (40)..(40): Pegylated
  MOD_RES (40)..(40): C-terminal amidation
YXEGTFTSDYSIYLDKQAAXEFVNWLLAGGPSSGAPPPSC

SEQ ID NO: 761 - protein, 40 aa, Artificial sequence
  Synthetic polypeptide
  MOD_RES (2)..(2): Xaa is AIB
  MISC_FEATURE (16)..(20): Lactam bridge between side chains of amino acids at positions 16 and 20
  MOD_RES (40)..(40): Pegylated
  MOD_RES (40)..(40): C-terminal amidation
YXEGTFTSDYSIYLDEQAAKEFVNWLLAGGPSSGAPPPSC

SEQ ID NO: 762 - protein, 40 aa, Artificial Sequence; identical to SEQ ID NO: 760
  Synthetic polypeptide
  MOD_RES (2)..(2): Xaa is AIB
  MOD_RES (20)..(20): Xaa is AIB
  MOD_RES (40)..(40): Pegylated
  MOD_RES (40)..(40): C-terminal amidation

SEQ ID NO: 763 - protein, 40 aa, Artificial Sequence; identical to SEQ ID NO: 759
  Synthetic polypeptide
  MOD_RES (2)..(2): Xaa is AIB
  MOD_RES (20)..(20): Xaa is AIB
  MOD_RES (24)..(24): Pegylated
  MOD_RES (40)..(40): C-terminal amidation

SEQ ID NO: 764 - protein, 40 aa, Artificial Sequence; identical to SEQ ID NO: 756
  Synthetic polypeptide
  MOD_RES (2)..(2): Xaa is AIB
  MOD_RES (20)..(20): Xaa is AIB
  MOD_RES (40)..(40): Acylated with fatty acyl group
  MOD_RES (40)..(40): C-terminal amidation

SEQ ID NO: 765 - protein, 40 aa, Artificial Sequence
  Synthetic polypeptide
  MOD_RES (2)..(2): Xaa is AIB
  MOD_RES (10)..(10): Acylated with fatty acyl group via dipeptide spacer
  MOD_RES (20)..(20): Xaa is AIB
  MOD_RES (40)..(40): C-terminal amidation
YXEGTFTSDKSIYLDKQAAXEFVNWLLAGGPSSGAPPPSK

SEQ ID NO: 766 - protein, 40 aa, Artificial Sequence
  Synthetic polypeptide
  MOD_RES (2)..(2): Xaa is AIB
  MOD_RES (20)..(20): Xaa is AIB
  MOD_RES (24)..(24): Pegylated
  MOD_RES (40)..(40): C-terminal amidation
YXQGTFTSDYSIYLDKQAAXEFVCWLLAGGPSSGAPPPSK

SEQ ID NO: 767 - protein, 29 aa, Artificial Sequence
  Synthetic peptide
  MOD_RES (3)..(3): Xaa is Acetyldiaminobutanoic acid
  MOD_RES (16)..(16): Xaa is AIB
  MOD_RES (29)..(29): C-terminal amidation
HSXGTFTSDYSKYLDXRRAADFVAWLLDE

SEQ ID NO: 768 - protein, 29 aa, Artificial Sequence
  Synthetic peptide
  MOD_RES (3)..(3): Xaa is Acetyldiaminobutanoic acid
  MOD_RES (16)..(16): Xaa is AIB
  MOD_RES (29)..(29): C-terminal amidation
HSXGTFTSDYSKYLDXERAADFVAWLLDE

SEQ ID NO: 769 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (26)..(26): Pegylated
  MOD_RES (31)..(31): C-terminal amidation
XXHXEGTFTSDYSKYLDEQAAKEFICWLMNT

SEQ ID NO: 770 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (12)..(12): Acylated with fatty acyl group
  MOD_RES (18)..(18): Xaa is AIB
  MOD_RES (31)..(31): C-terminal amidation
XXHXQGTFTSDKSKYLDXRAAQDFVQWLMDT

SEQ ID NO: 771 - protein, 42 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (42)..(42): C-terminal amidation
XXHXEGTFTSDVSSYLEEQAAKEFIAWLVKGGPSSGAPPPSK

SEQ ID NO: 772 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): d-Ser
  MISC_FEATURE (18)..(22): Lactam ring between side chains of amino acids at positions 18 and 22
  MOD_RES (26)..(26): Pegylated
  MOD_RES (31)..(31): C-terminal amidation
XXHSQGTFTSDYSLYLDERAAKDFVCWLLDT

SEQ ID NO: 773 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (18)..(18): Xaa is AIB
  MOD_RES (22)..(22): Xaa is AIB
  MOD_RES (26)..(26): Pegylated
  MOD_RES (31)..(31): C-terminal amidation
XXHXQGTFTSDYSKYLDXKRAXEFVCWLLDT

SEQ ID NO: 774 - protein, 31 aa, Artificial Sequence; identical to SEQ ID NO: 770
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (12)..(12): Acylated with fatty acyl group via dipeptide spacer
  MOD_RES (18)..(18): Xaa is AIB
  MOD_RES (31)..(31): C-terminal amidation

SEQ ID NO: 775 - protein, 31 aa, Artificial Sequence; identical to SEQ ID NO: 770
  Synthetic peptide
  MOD_RES (1)..(1): Xaa is AIB, d-Cys, d-Lys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (12)..(12): Acylated with fatty acyl group via acidic amino acid spacer
  MOD_RES (18)..(18): Xaa is AIB
  MOD_RES (31)..(31): C-terminal amidation

SEQ ID NO: 776 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): d-Ser
  MOD_RES (12)..(12): Acylated with fatty acyl group via dipeptide spacer
  MOD_RES (18)..(18): Xaa is AIB
  MOD_RES (31)..(31): C-terminal amidation
XXHSQGTFTSDKSKYLDXRAAQDFVQWLMDT

SEQ ID NO: 777 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (12)..(12): Acylated with fatty acyl group via dipeptide spacer
  MOD_RES (18)..(18): Xaa is AIB
  MOD_RES (31)..(31): C-terminal amidation
XXHXQGTFTSDKSKYLDXRAAQDFVQWLLDT

SEQ ID NO: 778 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (12)..(12): Acylated with fatty acyl group via dipeptide spacer
  MOD_RES (31)..(31): C-terminal amidation
XXHXQGTFTSDKSKYLDERAAQDFVQWLMDT

SEQ ID NO: 779 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (12)..(12): Acylated with fatty acyl group via dipeptide spacer
  MOD_RES (18)..(18): Xaa is AIB
  MOD_RES (31)..(31): C-terminal amidation
XXHXQGTFTSDKSKYLEXRAAQDFVQWLMDT

SEQ ID NO: 780 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): d-Ser
  MOD_RES (12)..(12): Acylated with fatty acyl group via acidic amino acid spacer
  MOD_RES (31)..(31): C-terminal amidation
XXHSQGTFTSDKSKYLDERAAQDFVQWLLDT

SEQ ID NO: 781 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (12)..(12): Acylated with fatty acyl group via acidic amino acid spacer
  MOD_RES (31)..(31): C-terminal amidation
XXHXQGTFTSDKSKYLDEQAAKEFIAWLLDT

SEQ ID NO: 782 - protein, 42 aa, Artificial Sequence
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is Aib
  MOD_RES (22)..(22): Xaa is Aib
  MOD_RES (42)..(42): C-terminal amidation
XXYXEGTFTSDYSIYLDKQAAXEFVNWLLAGGPSSGAPPPSK

SEQ ID NO: 783 - protein, 41 aa, Artificial Sequence
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is Aib
  MOD_RES (22)..(22): Xaa is Aib
  MOD_RES (41)..(41): C-terminal amidation
XXYXEGTFTSDYSIYLDKQAAXEFVNWLLAGGPSSGAPPPS

SEQ ID NO: 784 - protein, 41 aa, Artificial Sequence
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is Aib
  MOD_RES (12)..(12): Acylated with fatty acyl group via dipeptide spacer
  MOD_RES (22)..(22): Xaa is AIB
  MOD_RES (41)..(41): C-terminal amidation
XXYXEGTFTSDKSIYLDKQAAXEFVNWLLAGGPSSGAPPPS

SEQ ID NO: 785 - protein, 42 aa, Artificial Sequence
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (22)..(22): Xaa is AIB
  MOD_RES (26)..(26): Pegylated
  MOD_RES (42)..(42): C-terminal amidation
XXYXEGTFTSDYSIYLDKQAAXEFVCWLLAGGPSSGAPPPSK

SEQ ID NO: 786 - protein, 42 aa, Artificial Sequence
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (22)..(22): Xaa is AIB
  MOD_RES (42)..(42): Pegylated
  MOD_RES (42)..(42): C-terminal amidation
XXYXEGTFTSDYSIYLDKQAAXEFVNWLLAGGPSSGAPPPSC

SEQ ID NO: 787 - protein, 42 aa, Artificial sequence
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MISC_FEATURE (18)..(22): Lactam bridge between side chains of amino acids at positions 18 and 22
  MOD_RES (42)..(42): Pegylated
  MOD_RES (42)..(42): C-terminal amidation
XXYXEGTFTSDYSIYLDEQAAKEFVNWLLAGGPSSGAPPPSC

SEQ ID NO: 788 - protein, 42 aa, Artificial Sequence; identical to SEQ ID NO: 786
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (22)..(22): Xaa is AIB
  MOD_RES (42)..(42): Pegylated
  MOD_RES (42)..(42): C-terminal amidation

SEQ ID NO: 789 - protein, 42 aa, Artificial Sequence; identical to SEQ ID NO: 785
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (22)..(22): Xaa is AIB
  MOD_RES (26)..(26): Pegylated
  MOD_RES (42)..(42): C-terminal amidation

SEQ ID NO: 790 - protein, 42 aa, Artificial Sequence; identical to SEQ ID NO: 782
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (22)..(22): Xaa is AIB
  MOD_RES (42)..(42): Acylated with fatty acyl group
  MOD_RES (42)..(42): C-terminal amidation

SEQ ID NO: 791 - protein, 42 aa, Artificial Sequence
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (12)..(12): Acylated with fatty acyl group via dipeptide spacer
  MOD_RES (22)..(22): Xaa is AIB
  MOD_RES (42)..(42): C-terminal amidation
XXYXEGTFTSDKSIYLDKQAAXEFVNWLLAGGPSSGAPPPSK

SEQ ID NO: 792 - protein, 42 aa, Artificial Sequence
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (22)..(22): Xaa is AIB
  MOD_RES (26)..(26): Pegylated
  MOD_RES (42)..(42): C-terminal amidation
XXYXQGTFTSDYSIYLDKQAAXEFVCWLLAGGPSSGAPPPSK

SEQ ID NO: 793 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (5)..(5): Xaa is Acetyldiaminobutanoic acid
  MOD_RES (18)..(18): Xaa is AIB
  MOD_RES (31)..(31): C-terminal amidation
XXHSXGTFTSDYSKYLDXRRAADFVAWLLDE

SEQ ID NO: 794 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (5)..(5): Xaa is Acetyldiaminobutanoic acid
  MOD_RES (18)..(18): Xaa is AIB
  MOD_RES (31)..(31): C-terminal amidation
XXHSXGTFTSDYSKYLDXERAADFVAWLLDE

SEQ ID NO: 795-800 - skipped (6 entries)

SEQ ID NO: 801 - protein, 29 aa, Homo sapiens
HSQGTFTSDYSKYLDSRRAQDFVQWLMNT

SEQ ID NO: 802 - protein, 29 aa, Artificial Sequence
  Glucagon analogue
  MOD_RES (16)..(16): Xaa is Ser, Cys, Orn, homocysteine or acetyl phenyalanine
  MOD_RES (27)..(27): Xaa is Met, Leu or Nle
HSQGTFTSDYSKYLDXRRAQDFVQWLXDT

SEQ ID NO: 803 - protein, 29 aa, Artificial Sequence
  Glucagon analogue
  MOD_RES (17)..(17): Xaa is Arg, Cys, Orn, homocysteine or acetyl phenyalanine
  MOD_RES (27)..(27): Xaa is Met, Leu or Nle
HSQGTFTSDYSKYLDSXRAQDFVQWLXDT

SEQ ID NO: 804 - protein, 29 aa, Artificial Sequence
  Glucagon analogue
  MOD_RES (21)..(21): Xaa is Asp, Cys, Orn, homocysteine or acetyl phenylalanine
  MOD_RES (27)..(27): Xaa is Met, Leu or Nle
HSQGTFTSDYSKYLDSRRAQXFVQWLXDT

SEQ ID NO: 805 - protein, 29 aa, Artificial Sequence
  Synthetic peptide
  MOD_RES (24)..(24): Xaa is Gln, Cys, Orn, homocysteine or acetyl phenylalanine
  MOD_RES (27)..(27): Xaa is Met, Leu or Nle
HSQGTFTSDYSKYLDSRRAQDFVXWLXDT

SEQ ID NO: 806 - protein, 29 aa, Artificial Sequence
  Glucagon analogue
  MOD_RES (21)..(21): Xaa is Asp, Cys, Orn, homocysteine or acetyl phenyalanine
  MOD_RES (24)..(24): Xaa is Gln, Cys, Orn, homocysteine or acetyl phenyalanine
  MOD_RES (27)..(27): Xaa is Met, Leu or Nle
HSQGTFTSDYSKYLDSRRAQXFVXWLXDT

SEQ ID NO: 807 - protein, 29 aa, Artificial Sequence
  Glucagon analogue
  MOD_RES (27)..(27): Xaa is Met, Leu or Nle
  MOD_RES (28)..(28): Xaa is Lys, Arg, His, Asp, Glu, cysteic acid or homocysteic acid
  MOD_RES (29)..(29): Xaa is Thr, Lys, Arg, His, Asp, Glu, cysteic acid or homocysteic acid
HSQGTFTSDYSKYLDSRRAQDFVQWLXXX

SEQ ID NO: 808 - protein, 29 aa, Artificial Sequence
  Glucagon analogue
  MOD_RES (27)..(27): Xaa is Met, Leu or Nle
  MOD_RES (28)..(28): Xaa is Asp or Glu
  MOD_RES (29)..(29): Xaa is Thr, Asp or Glu
HSQGTFTSDYSKYLDSRRAQDFVQWLXXX

SEQ ID NO: 809 - protein, 29 aa, Artificial Sequence
  Glucagon analogue
  MOD_RES (27)..(27): Xaa is Met, Leu or Nle
  MOD_RES (29)..(29): Xaa is Asp or Glu
HSQGTFTSDYSKYLDSRRAQDFVQWLXNX

SEQ ID NO: 810 - protein, 29 aa, Artificial Sequence
  Synthetic peptide
  MOD_RES (27)..(27): Xaa is Met, Leu or Nle
HSQGTFTSDYSKYLDSRRAQDFVQWLXDT

SEQ ID NO: 811 - protein, 29 aa, Artificial Sequence
  Glucagon analogue
HSQGTFTSDYSKYLDSRRAQDFVQWLMDT

SEQ ID NO: 812 - protein, 29 aa, Artificial Sequence
  Glucagon analogue
  MOD_RES (29)..(29): Xaa is Lys, Arg or His
HSQGTFTSDYSKYLDSRRAQDFVQWLMNX

SEQ ID NO: 813 - protein, 29 aa, Artificial Sequence
  Glucagon analogue
HSQGTFTSDYSKYLESRRAQDFVQWLMDT

SEQ ID NO: 814 - protein, 29 aa, Artificial Sequence
  Synthetic peptide
  MOD_RES (16)..(16): Pegylation
  MOD_RES (27)..(27): Xaa is Met, Leu or Nle
HSQGTFTSDYSKYLDCRRAQDFVQWLXDT

SEQ ID NO: 815 - protein, 29 aa, Artificial Sequence
  Glucagon analogue
  MOD_RES (17)..(17): Pegylation
  MOD_RES (27)..(27): Xaa is Met, Leu or Nle
HSQGTFTSDYSKYLDSCRAQDFVQWLXDT

SEQ ID NO: 816 - protein, 29 aa, Artificial Sequence
  Glucagon analogue
  MOD_RES (21)..(21): Pegylation
  MOD_RES (27)..(27): Xaa is Met, Leu or Nle
HSQGTFTSDYSKYLDSRRAQCFVQWLXDT

SEQ ID NO: 817 - protein, 29 aa, Artificial Sequence
  Glucagon analogue
  MOD_RES (24)..(24): Pegylation
  MOD_RES (27)..(27): Xaa is Met, Leu or Nle
HSQGTFTSDYSKYLDSRRAQDFVCWLXDT

SEQ ID NO: 818 - protein, 29 aa, Artificial Sequence
  Glucagon analogue
  MOD_RES (21)..(21): Pegylation
  MOD_RES (27)..(27): Xaa is Met, Leu or Nle
HSQGTFTSDYSRYLDSRRAQKFVQWLXDT

SEQ ID NO: 819 - protein, 29 aa, Artificial Sequence
  Glucagon analogue
  MOD_RES (24)..(24): Pegylation
  MOD_RES (27)..(27): Xaa is Met, Leu or Nle
HSQGTFTSDYSRYLDSRRAQDFVKWLXDT

SEQ ID NO: 820 - protein, 10 aa, Artificial Sequence
  Synthetic peptide
  MISC_FEATURE: Peptide fragment representing carboxy terminal 10 amino acids of Exendin-4
GPSSGAPPPS

SEQ ID NO: 821 - protein, 8 aa, Artificial Sequence
  Synthetic peptide
  MISC_FEATURE: Peptide fragment representing the carboxy terminal 8 amino acids of oxyntomodulin
KRNRNNIA

SEQ ID NO: 822 - protein, 4 aa, Artificial Sequence
  Synthetic peptide
  MISC_FEATURE: Peptide fragment representing the amino 4 amino acids of oxyntomodulin carboxy terminus of SEQ ID NO: 21
KRNR

SEQ ID NO: 823 - protein, 10 aa, Artificial Sequence
  Synthetic peptide
  MISC_FEATURE: Peptide fragment representing the carboxy terminal 10 amino acids of Exendin-4
  MOD_RES (10)..(10): AMIDATION
GPSSGAPPPS

SEQ ID NO: 824 - protein, 39 aa, Artificial Sequence
  Glucagon analogue
HSQGTFTSDYSKYLDSRRAQDFVQWLMDTGPSSGAPPPS

SEQ ID NO: 825 - protein, 37 aa, Artificial Sequence; identical to SEQ ID NO: 706
  Glucagon analogue

SEQ ID NO: 826 - protein, 33 aa, Artificial Sequence
  Glucagon analogue
HSQGTFTSDYSKYLDSRRAQDFVQWLMDTKRNR

SEQ ID NO: 827 - protein, 29 aa, Artificial Sequence
  Glucagon analogue
HSQGTFTSDYSKYLDSCRAQDFVQWLMNT

SEQ ID NO: 828 - protein, 39 aa, Artificial Sequence; identical to SEQ ID NO: 521
  Synthetic peptide

SEQ ID NO: 829 - protein, 29 aa, Artificial Sequence
  Glucagon analogue
  MOD_RES (24)..(24): 2-butyrolactone bound through Cys thiol group
HSQGTFTSDYSKYLDSRRAQDFVQWLMNT

SEQ ID NO: 830 - protein, 29 aa, Artificial Sequence
  Glucagon analogue
  MOD_RES (24)..(24): Carboxymethyl group bound through Cys thiol group
HSQGTFTSDYSKYLDSRRAQDFVQWLMNT

SEQ ID NO: 831 - protein, 39 aa, Artificial Sequence; identical to SEQ ID NO: 521
  Glucagon analogue

SEQ ID NO: 832 - protein, 30 aa, Artificial Sequence
  Glucagon analog
  MOD_RES (30)..(30): Xaa is Asp, Glu, Lys, Arg or His
HSQGTFTSDYSKYLDSRRAQDFVQWLMDTX

SEQ ID NO: 833 - protein, 29 aa, Artificial Sequence
  Glucagon analogue
  MOD_RES (15)..(15): Xaa is Asp, Glu, cysteic acid, homoglutamic acid or homocysteic acid
  MOD_RES (27)..(27): Xaa is Met, Leu or Nle
  MOD_RES (28)..(28): Xaa is Asn, Lys, Arg, His, Asp or Glu
  MOD_RES (29)..(29): Xaa is Thr, Lys, Arg, His, Asp or Glu
HSQGTFTSDYSKYLXSRRAQDFVQWLXXX

SEQ ID NO: 834 - protein, 29 aa, Artificial Sequence
  Glucagon analogue
  MOD_RES (15)..(15): Xaa is Asp, Glu, cysteic acid, homoglutamic acid or homocysteic acid
  MOD_RES (27)..(27): Xaa is Met, Leu or Nle
  MOD_RES (28)..(28): Xaa is Asn or an acidic amino acid
  MOD_RES (29)..(29): Xaa is Thr or an acidic amino acid
HSQGTFTSDYSKYLXSRRAQDFVQWLXXX

SEQ ID NO: 835 - protein, 39 aa, Artificial Sequence
  Synthetic peptide
HSQGTFTSDYSKYLDSRRAQDFVQWLMETGPSSGAPPPS

SEQ ID NO: 836 - protein, 37 aa, Artificial Sequence
  Glucagon analogue
HSQGTFTSDYSKYLDSRRAQDFVQWLMETKRNRNNIA

SEQ ID NO: 837 - protein, 33 aa, Artificial Sequence
  Glucagon analogue
HSQGTFTSDYSKYLDSRRAQDFVQWLMETKRNR

SEQ ID NO: 838 - protein, 29 aa, Artificial Sequence
  Glucagon analogue
HSQGTFTSDYSKYLDSRRAQDFVQWLMET

SEQ ID NO: 839 - protein, 27 aa, Artificial Sequence
  Synthetic peptide
  MOD_RES (1)..(1): Xaa is an amino acid that reduces susceptibility of the incretin peptide to cleavage by dipeptidyl peptidase IV
  MOD_RES (2)..(2): Xaa is an amino acid that reduces susceptibility of the incretin peptide to cleavage by dipeptidyl peptidase IV
  MOD_RES (27)..(27): Met comprises Z
XXQGTFTSDYSKYLDSRRAQDFVQWLM

SEQ ID NO: 840 - protein, 29 aa, Artificial Sequence
  Synthetic peptide
  MOD_RES (1)..(1): Xaa is alpha, alpha-dimethyl imidiazole acetic acid (DMIA)
  MISC_FEATURE (16)..(20): Lactam bridge between residues 16 and 20
  MOD_RES (24)..(24): Pegylation
XSQGTFTSDYSKYLDERRAKDFVCWLMNT

SEQ ID NO: 841 - protein, 29 aa, Artificial Sequence
  Synthetic peptide
  MOD_RES (1)..(1): Xaa is alpha, alpha-dimethyl imidiazole acetic acid (DMIA)
  MISC_FEATURE (16)..(20): Lactam bridge between residues 16 and 20
  MOD_RES (24)..(24): Glutamine to alanine mutation
  MOD_RES (29)..(29): Pegylation
XSQGTFTSDYSKYLDERRAKDFVAWLMNC

SEQ ID NO: 842 - protein, 29 aa, Artificial Sequence
  Synthetic peptide
  MOD_RES (1)..(1): Xaa is alpha, alpha-dimethyl imidiazole acetic acid (DMIA)
  MISC_FEATURE (16)..(20): Lactam bridge between residues 16 and 20
  MOD_RES (24)..(24): Pegylation
  MOD_RES (27)..(27): Xaa is Nle or Leu
XSQGTFTSDYSKYLDERRAKDFVCWLXNT

SEQ ID NO: 843 - protein, 29 aa, Artificial Sequence
  Synthetic peptide
  MOD_RES (1)..(1): Xaa is alpha, alpha-dimethyl imidiazole acetic acid (DMIA)
  MISC_FEATURE (16)..(20): Lactam bridge between residues 16 and 20
  MISC_FEATURE (24)..(24): Glutamine to alanine mutation
  MISC_FEATURE (27)..(27): Xaa is Nle or Leu
  MOD_RES (29)..(29): Pegylation
XSQGTFTSDYSKYLDERRAKDFVAWLXNC

SEQ ID NO: 844 - protein, 29 aa, Artificial Sequence
  Synthetic peptide
  MISC_FEATURE: SEQ ID NO: 1 with  Ala 20, Ala 24, Nle 27, and Asp 28
  MOD_RES (27)..(27): Xaa is Nle
HSQGTFTSDYSKYLDSRRAADFVAWLXDT

SEQ ID NO: 845 - protein, 29 aa, Artificial Sequence
  Synthetic peptide
  MISC_FEATURE: SEQ ID NO: 1 with Ala 20, Ala 24, Nle27 , Asp 28, and Glu 29
  MOD_RES (27)..(27): Xaa is Nle
HSQGTFTSDYSKYLDSRRAADFVAWLXDE

SEQ ID NO: 846 - protein, 30 aa, Artificial Sequence
  Synthetic peptide
  MISC_FEATURE: SEQ ID NO: 1 with Ala 20, Ala 24, Nle 27, Asp 28, and Glu 30
  MOD_RES (27)..(27): Xaa is Nle
HSQGTFTSDYSKYLDSRRAADFVAWLXDTE

SEQ ID NO: 847 - protein, 29 aa, Artificial Sequence
  Synthetic peptide
  MISC_FEATURE: SEQ ID NO: 1 with Ala 20, Ala 24, Nle 27, Glu 28, and Glu 29
  MOD_RES (27)..(27): Xaa is Nle
HSQGTFTSDYSKYLDSRRAADFVAWLXEE

SEQ ID NO: 848 - protein, 30 aa, Artificial Sequence
  Synthetic peptide
  MISC_FEATURE: SEQ ID NO: 1 with Ala 20, Ala 24, Nle 27, Glu 28, and Glu 30
  MOD_RES (27)..(27): Xaa is Nle
HSQGTFTSDYSKYLDSRRAADFVAWLXETE

SEQ ID NO: 849 - protein, 30 aa, Artificial Sequence
  Synthetic peptide
  MOD_RES (27)..(27): Xaa is Nle
  MISC_FEATURE (27)..(27): SEQ ID NO: 1 with Ala 20, Ala 24, Nle 27, Glu 29, and Glu 30
HSQGTFTSDYSKYLDSRRAADFVAWLXNEE

SEQ ID NO: 850 - protein, 29 aa, Artificial Sequence
  Synthetic peptide
  MISC_FEATURE: SEQ ID NO: 1 with Ala 20, Glu 21, Ala 24, Nle 27, and Asp 28
  MOD_RES (27)..(27): Xaa is Nle
HSQGTFTSDYSKYLDSRRAAEFVAWLXDT

SEQ ID NO: 851 - protein, 29 aa, Artificial Sequence
  Synthetic peptide
  MISC_FEATURE: SEQ ID NO: 1 with Ala 20, Glu 21, Ala 24, Nle 27, Asp 28, and Glu 29
  MOD_RES (27)..(27): Xaa is Nle
HSQGTFTSDYSKYLDSRRAAEFVAWLXDE

SEQ ID NO: 852 - protein, 29 aa, Artificial Sequence
  Synthetic peptide
  MISC_FEATURE: SEQ ID NO: 1 with Ala 20, Glu 21, Ala 24, Nle 27, Asp 28, and Glu 30
  MOD_RES (27)..(27): Xaa is Nle
HSQGTFTSDYSKYLDSRRAAEFVAWLXDE

SEQ ID NO: 853 - protein, 29 aa, Artificial Sequence
  Synthetic peptide
  MISC_FEATURE: SEQ ID NO :1 with Ala 20, Glu 21, Ala 24, Nle 27, Glu 28, and Glu 29
  MOD_RES (27)..(27): Xaa is Nle
HSQGTFTSDYSKYLDSRRAAEFVAWLXEE

SEQ ID NO: 854 - protein, 29 aa, Artificial Sequence
  Synthetic peptide
  MISC_FEATURE: SEQ ID NO: 1 with Ala 20, Glu 21, Ala 24, Nle 27, Glu 28, and Glu 30
HSQGTFTSDYSKYLDSRRAQDFVQWLMNT

SEQ ID NO: 855 - protein, 30 aa, Artificial Sequence
  Synthetic peptide
  MISC_FEATURE: SEQ ID NO: 1 with Ala 20, Glu 21, Ala 24, Nle 27, Glu 29, and Glu 30
  MOD_RES (27)..(27): Xaa is Nle
HSQGTFTSDYSKYLDSRRAAEFVAWLXNEE

SEQ ID NO: 856 - protein, 29 aa, Artificial Sequence
  Synthetic peptide
  MISC_FEATURE: SEQ ID NO: 1 with Thr 16, Ala 20, Glu 21, Ala 24, Nle 27, Asp 28, and Glu29
  MOD_RES (27)..(27): Xaa is Nle
HSQGTFTSDYSKYLDTRRAAEFVAWLXDE

SEQ ID NO: 857 - protein, 31 aa, Homo sapiens; identical to SEQ ID NO: 703

SEQ ID NO: 858 - protein, 30 aa, Homo sapiens; identical to SEQ ID NO: 704
  MOD_RES (30)..(30): AMIDATION

SEQ ID NO: 859 - protein, 29 aa, Artificial Sequence
  Synthetic peptide
  MOD_RES (3)..(3): Xaa is Glutamine analog
  MOD_RES (27)..(27): Xaa is Nle
HSXGTFTSDYSKYLDTRRAAEFVAWLXDE

SEQ ID NO: 860 - protein, 29 aa, Artificial Sequence
  Synthetic peptide
  MOD_RES (3)..(3): Xaa is Glutamine analog
  MOD_RES (16)..(16): Xaa is Aminoisobutryic acid
HSXGTFTSDYSKYLDXRRAADFVAWLMDE

SEQ ID NO: 861 - protein, 29 aa, Artificial Sequence
  Synthetic peptide
  MOD_RES (27)..(27): Xaa is Nle
HSQGTFTSDYSKYLDTRRAAEFVAWLXDE

SEQ ID NO: 862 - protein, 29 aa, Artificial Sequence
  Synthetic peptide
  MOD_RES (3)..(3): Xaa is Acetamidomethyl-cysteine
  MOD_RES (27)..(27): Xaa is Nle
HSXGTFTSDYSKYLDTRRAAEFVAWLXDE

SEQ ID NO: 863 - protein, 29 aa, Artificial Sequence
  Synethic peptide
  MOD_RES (3)..(3): Xaa is Acetyldiaminobutanoic acid
  MOD_RES (27)..(27): Xaa is Nle
HSXGTFTSDYSKYLDTRRAAEFVAWLXDE

SEQ ID NO: 864 - protein, 29 aa, Artificial Sequence
  Synthetic peptide
  MOD_RES (3)..(3): Xaa is Carbamoyldiaminopropanoic acid
  MOD_RES (27)..(27): Xaa is Nle
HSXGTFTSDYSKYLDTRRAAEFVAWLXDE

SEQ ID NO: 865 - protein, 29 aa, Artificial Sequence
  Synthetic peptide
  MOD_RES (3)..(3): Xaa is Methylglutamine
  MOD_RES (27)..(27): Xaa is Nle
HSXGTFTSDYSKYLDTRRAAEFVAWLXDE

SEQ ID NO: 866 - protein, 29 aa, Artificial Sequence
  Synthetic peptide
  MOD_RES (3)..(3): Xaa is Methionine sulfoxide
  MOD_RES (27)..(27): Xaa is Nle
HSXGTFTSDYSKYLDTRRAAEFVAWLXDE

SEQ ID NO: 867 - protein, 29 aa, Artificial Sequence
  Synthetic peptide
  MOD_RES (3)..(3): Xaa is Acetylornithine
  MOD_RES (27)..(27): Xaa is Nle
HSXGTFTSDYSKYLDTRRAAEFVAWLXDE

SEQ ID NO: 868 - protein, 29 aa, Artificial Sequence
  Synthetic peptide
  MOD_RES (16)..(16): Xaa is Aminoisobutryic acid
HSQGTFTSDYSKYLDXRRAADFVAWLMDE

SEQ ID NO: 869 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutryic acid
HSXGTFTSDYSKYLDXRRAADFVAWLMDE

SEQ ID NO: 870 - protein, 29 aa, Artificial Sequence
  Synthetic peptide
  MOD_RES (3)..(3): Xaa is Methylglutamine
  MOD_RES (16)..(16): Xaa is Aib
HSXGTFTSDYSKYLDXRRAADFVAWLMDE

SEQ ID NO: 871 - protein, 29 aa, Artificial Sequence
  Synthetic peptide
  MOD_RES (3)..(3): Xaa is acetyldiaminobutanoic acid
  MOD_RES (16)..(16): Xaa is Aib
HSXGTFTSDYSKYLDXRRAADFVAWLLDE

SEQ ID NO: 872 - protein, 39 aa, Artificial Sequence; identical to SEQ ID NO: 604
  Synthetic peptide
  MOD_RES (3)..(3): Xaa is Acetyldiaminobutanoic acid
  MOD_RES (16)..(16): Aminoisobutryic Acid
  MOD_RES (39)..(39): AMIDATION

SEQ ID NO: 873 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutryric acid
HSXGTFTSDYSKYLDXRRASDFVSWLLDE

SEQ ID NO: 874 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutryic acid
HSXGTFTSDYSKYLDXRRATDFVTWLLDE

SEQ ID NO: 875 - protein, 29 aa, Artificial Sequence
  Synthetic peptide
HSQGTFTSDYSKYLDSRRAQDFVQWLMDE

SEQ ID NO: 876 - protein, 29 aa, Artificial Sequence
  Synthetic peptide
  MOD_RES (16)..(16): Xaa is Aib
HSQGTFTSDYSKYLDXRRAQDFVQWLMDE

SEQ ID NO: 877 - protein, 29 aa, Artificial Sequence
  Synthetic peptide
  misc_feature (3)..(3): Xaa can be any naturally occurring amino acid
HSXGTFTSDYSKYLDSRRAQDFVQWLMNT

SEQ ID NO: 878 - protein, 29 aa, Artificial Sequence
  Synthetic peptide
HSQGTFTSDYSKYLDSRRAQDFVQWLMDT

SEQ ID NO: 879 - protein, 30 aa, Artificial Sequence; identical to SEQ ID NO: 581
  Synthetic peptide
  MOD_RES (2)..(2): Xaa is d-Ser
  MOD_RES (30)..(30): Acylated with a C14 fatty acyl group
  MOD_RES (30)..(30): AMIDATION

SEQ ID NO: 880 - protein, 29 aa, Artificial Sequence
  Synthetic peptide
  MOD_RES (2)..(2): Xaa is d-Ser
  MOD_RES (10)..(10): Acylated with a C14 fatty acyl group
  MOD_RES (29)..(29): AMIDATION
HXQGTFTSDKSKYLDERRAKDFVQWLMNT

SEQ ID NO: 881 - protein, 30 aa, Artificial Sequence; identical to SEQ ID NO: 581
  Synthetic peptide
  MOD_RES (2)..(2): Xaa is d-Ser
  MOD_RES (30)..(30): Acylated with a C16 fatty acyl group
  MOD_RES (30)..(30): AMIDATION

SEQ ID NO: 882 - protein, 29 aa, Artificial Sequence
  Synthetic peptide
  MOD_RES (2)..(2): Xaa is d-Ser
  MOD_RES (10)..(10): Acylated with a C16 fatty acyl group
  MOD_RES (29)..(29): AMIDATION
HXQGTFTSDKSKYLDERRAKDFVQWLMNT

SEQ ID NO: 883 - protein, 29 aa, Artificial Sequence
  Synthetic peptide
  MOD_RES (2)..(2): Aminoisobutryic Acid
  MOD_RES (10)..(10): Acylated with a C18 fatty acyl group
  MOD_RES (24)..(24): Cys-PEG
  MOD_RES (29)..(29): AMIDATION
HXQGTFTSDKSKYLDEQAAKEFICWLMNT

SEQ ID NO: 884 - protein, 30 aa, Artificial Sequence; identical to SEQ ID NO: 586
  Synthetic peptide
  MOD_RES (2)..(2): Aminoisobutryic Acid
  MOD_RES (24)..(24): Cys-PEG
  MOD_RES (30)..(30): Acylated with a C18 fatty acyl group
  MOD_RES (30)..(30): AMIDATION

SEQ ID NO: 885 - protein, 29 aa, Artificial sequence
  Synthetic peptide
  MOD_RES (16)..(16): Xaa is Ser or alpha, alpha-disubstituted amino acid
  MOD_RES (20)..(20): Xaa is Gln or alpha, alpha-disubstituted amino acid
  MOD_RES (21)..(21): Xaa is Asp or alpha, alpha-disubstituted amino acid
  MOD_RES (24)..(24): Xaa is Gln or alpha, alpha-disubstituted amino acid
HSQGTFTSDYSKYLDXRRAXXFVXWLMNT

SEQ ID NO: 886 - protein, 29 aa, Artificial Sequence
  Synthetic peptide
  MOD_RES (16)..(16): Xaa is Aib
HSQGTFTSDYSKYLDXRRAQDFVQWLMNT

SEQ ID NO: 887 - protein, 29 aa, Artificial Sequence
  Synthetic peptide
  MOD_RES (19)..(19): Xaa is Aib
HSQGTFTSDYSKYLDSRRXQDFVQWLMNT

SEQ ID NO: 888 - protein, 29 aa, Artificial Sequence
  Synthetic peptide
  MOD_RES (20)..(20): Xaa is Aib
HSQGTFTSDYSKYLDSRRAXDFVQWLMNT

SEQ ID NO: 889 - protein, 29 aa, Artificial Sequence
  Synthetic peptide
  MOD_RES (21)..(21): Xaa is Aib
HSQGTFTSDYSKYLDSRRAQXFVQWLMNT

SEQ ID NO: 890 - protein, 29 aa, Artificial Sequence
  Synthetic peptide
  MOD_RES (24)..(24): Xaa is Aib
HSQGTFTSDYSKYLDSRRAQDFVXWLMNT

SEQ ID NO: 891 - protein, 29 aa, Artificial Sequence
  Synthetic peptide
  MOD_RES (16)..(16): Xaa is Aib
  MOD_RES (20)..(20): Xaa is Aib
HSQGTFTSDYSKYLDXRRAXDFVQWLMNT

SEQ ID NO: 892 - protein, 29 aa, Artificial Sequence
  Synthetic peptide
  MOD_RES (16)..(16): Xaa is Aib
  MOD_RES (24)..(24): Xaa is Aib
HSQGTFTSDYSKYLDXRRAQDFVXWLMNT

SEQ ID NO: 893 - protein, 29 aa, Artificial Sequence
  Synthetic peptide
  MOD_RES (20)..(20): Xaa is Aib
  MOD_RES (24)..(24): Xaa is Aib
HSQGTFTSDYSKYLDSRRAXDFVXWLMNT

SEQ ID NO: 894 - protein, 29 aa, Artificial Sequence
  Synthetic peptide
  MOD_RES (16)..(16): Xaa is Aib
  MOD_RES (20)..(20): Xaa is Aib
  MOD_RES (24)..(24): Xaa is Aib
HSQGTFTSDYSKYLDXRRAXDFVXWLMNT

SEQ ID NO: 895 - protein, 29 aa, Artificial Sequence
  Synthetic peptide
  MOD_RES (2)..(2): Xaa is Aib
  MOD_RES (16)..(16): Xaa is Aib
  MOD_RES (29)..(29): AMIDATION
HXQGTFTSDKSKYLDXRRAQDFVQWLMNT

SEQ ID NO: 896 - protein, 29 aa, Artificial Sequence
  Synthetic peptide
  MOD_RES (2)..(2): Xaa is Aib
  MOD_RES (16)..(16): Xaa is Aib
  MOD_RES (29)..(29): AMIDATION
HXQGTFTSDYSKYLDXRRAQDFVQWLMNT

SEQ ID NO: 897 - protein, 29 aa, Artificial Sequence
  Synthetic peptide
  MOD_RES (2)..(2): Xaa is Aib
  MOD_RES (10)..(10): Acylated with a C16 fatty acyl group
  MOD_RES (16)..(16): Xaa is Aib
  MOD_RES (29)..(29): AMIDATION
HXQGTFTSDKSKYLDXRRAQDFVQWLMNT

SEQ ID NO: 898 - protein, 29 aa, Artificial Sequence
  Synthetic peptide
  MOD_RES (2)..(2): Xaa is Aib
  MOD_RES (10)..(10): Acylated with a C16 fatty acyl group via Ala-Ala spacer
  MOD_RES (16)..(16): Xaa is Aib
  MOD_RES (29)..(29): AMIDATION
HXQGTFTSDKSKYLDXRRAQDFVQWLMNT

SEQ ID NO: 899 - protein, 29 aa, Artificial Sequence
  Synthetic peptide
  MOD_RES (2)..(2): Xaa is Aib
  MOD_RES (10)..(10): Acylated with a C16 fatty acyl group via dipeptide spacer
  MOD_RES (16)..(16): Xaa is Aib
  MOD_RES (29)..(29): AMIDATION
HXQGTFTSDKSKYLDXRRAQDFVQWLMNT

SEQ ID NO: 900 - protein, 29 aa, Artificial Sequence
  Synthetic peptide
  MOD_RES (2)..(2): Xaa is Aib
  MOD_RES (10)..(10): Acylated with a C16 fatty acyl group via beta-Ala-beta-Ala spacer
  MOD_RES (16)..(16): Xaa is Aib
  MOD_RES (29)..(29): AMIDATION
HXQGTFTSDKSKYLDXRRAQDFVQWLMNT

SEQ ID NO: 901 - protein, 29 aa, Artificial Sequence
  Synthetic peptide
  MOD_RES (2)..(2): Xaa is Aib
  MOD_RES (10)..(10): Acylated with a C16 fatty acyl group via 6-aminohexanoic acid spacer
  MOD_RES (16)..(16): Xaa is Aib
  MOD_RES (29)..(29): AMIDATION
HXQGTFTSDKSKYLDXRRAQDFVQWLMNT

SEQ ID NO: 902 - protein, 29 aa, Artificial Sequence
  Synthetic peptide
  MOD_RES (2)..(2): Xaa is Aib
  MOD_RES (10)..(10): Acylated with a C16 fatty acyl group via Leu-Leu spacer
  MOD_RES (16)..(16): Xaa is Aib
  MOD_RES (29)..(29): AMIDATION
HXQGTFTSDKSKYLDXRRAQDFVQWLMNT

SEQ ID NO: 903 - protein, 29 aa, Artificial Sequence
  Synthetic peptide
  MOD_RES (2)..(2): Xaa is Aib
  MOD_RES (10)..(10): Acylated with a C16 fatty acyl group via Pro-Pro spacer
  MOD_RES (16)..(16): Xaa is Aib
  MOD_RES (29)..(29): AMIDATION
HXQGTFTSDKSKYLDXRRAQDFVQWLMNT

SEQ ID NO: 904 - protein, 29 aa, Artificial Sequence
  Synthetic peptide
  MOD_RES (2)..(2): Xaa is Aib
  MOD_RES (10)..(10): Acylated with a C14 fatty acyl group
  MOD_RES (16)..(16): Xaa is Aib
  MOD_RES (24)..(24): Cys-PEG
  MOD_RES (29)..(29): AMIDATION
HXQGTFTSDKSKYLDXRRAQDFVCWLMNT

SEQ ID NO: 905 - protein, 29 aa, Artificial Sequence
  Synthetic peptide
  MOD_RES (2)..(2): Xaa is Aib
  MOD_RES (10)..(10): Acylated with a C14 fatty acyl group via dipeptide spacer
  MOD_RES (16)..(16): Xaa is Aib
  MOD_RES (24)..(24): Cys-PEG
  MOD_RES (29)..(29): AMIDATION
HXQGTFTSDKSKYLDXRRAQDFVCWLMNT

SEQ ID NO: 906 - protein, 29 aa, Artificial Sequence
  Synthetic peptide
  MOD_RES (2)..(2): Xaa is Aib
  MOD_RES (10)..(10): Acylated with a C14 fatty acyl group via dipeptide spacer
  MOD_RES (16)..(16): Xaa is Aib
  MOD_RES (29)..(29): AMIDATION
HXQGTFTSDKSKYLDXRRAQDFVQWLMNT

SEQ ID NO: 907 - protein, 29 aa, Artificial Sequence
  Synthetic peptide
  MOD_RES (2)..(2): Xaa is Aib
  MOD_RES (10)..(10): Acylated with a C14 fatty acyl group via Ala-Ala spacer
  MOD_RES (16)..(16): Xaa is Aib
  MOD_RES (24)..(24): Cys-PEG
  MOD_RES (29)..(29): AMIDATION
HXQGTFTSDKSKYLDXRRAQDFVCWLMNT

SEQ ID NO: 908 - protein, 29 aa, Artificial Sequence
  Synthetic peptide
  MOD_RES (2)..(2): Xaa is Aib
  MOD_RES (10)..(10): Acylated with a C14 fatty acyl group via Ala-Ala spacer
  MOD_RES (16)..(16): Xaa is Aib
  MOD_RES (29)..(29): AMIDATION
HXQGTFTSDKSKYLDXRRAQDFVQWLMNT

SEQ ID NO: 909 - protein, 29 aa, Artificial Sequence
  Synthetic peptide
  MOD_RES (2)..(2): Xaa is Aib
  MOD_RES (10)..(10): Acylated with a C16 fatty acyl group via Ala-Ala spacer
  MOD_RES (16)..(16): Xaa is Aib
  MOD_RES (24)..(24): Cys-PEG
  MOD_RES (29)..(29): AMIDATION
HXQGTFTSDKSKYLDXRRAQDFVCWLMNT

SEQ ID NO: 910 - protein, 29 aa, Artificial Sequence
  Synthetic peptide
  MOD_RES (2)..(2): Xaa is Aib
  MOD_RES (10)..(10): Acylated with a C16 fatty acyl group via dipeptide spacer
  MOD_RES (16)..(16): Xaa is Aib
  MOD_RES (24)..(24): Cys-PEG
  MOD_RES (29)..(29): AMIDATION
HXQGTFTSDKSKYLDXRRAQDFVCWLMNT

SEQ ID NO: 911 - protein, 29 aa, Artificial Sequence
  Synthetic peptide
  MOD_RES (2)..(2): Xaa is Aib
  MOD_RES (10)..(10): Covalently bound to a C14 fatty acyl group
  MOD_RES (16)..(16): Xaa is Aib
  MOD_RES (29)..(29): AMIDATION
HXQGTFTSDKSKYLDXRRAQDFVCWLMNT

SEQ ID NO: 912 - protein, 29 aa, Artificial Sequence
  Synthetic peptide
  MOD_RES (2)..(2): Xaa is Aib
  MOD_RES (10)..(10): Covalently bound to C14 fatty acyl group via dipeptide spacer
  MOD_RES (16)..(16): Xaa is Aib
  MOD_RES (29)..(29): AMIDATION
HXQGTFTSDKSKYLDXRRAQDFVCWLMNT

SEQ ID NO: 913 - protein, 29 aa, Artificial Sequence
  Synthetic peptide
  MOD_RES (2)..(2): Xaa is Aib
  MOD_RES (10)..(10): Covalently bound to C14 fatty acyl group via Ala-Ala spacer
  MOD_RES (16)..(16): Xaa is Aib
  MOD_RES (29)..(29): AMIDATION
HXQGTFTSDKSKYLDXRRAQDFVCWLMNT

SEQ ID NO: 914 - protein, 29 aa, Artificial Sequence
  Synthetic peptide
  MOD_RES (2)..(2): Xaa is Aib
  MOD_RES (10)..(10): Covalently bound to C16 fatty acyl group via dipeptide spacer
  MOD_RES (16)..(16): Xaa is Aib
  MOD_RES (29)..(29): AMIDATION
HXQGTFTSDKSKYLDXRRAQDFVCWLMNT

SEQ ID NO: 915 - protein, 29 aa, Artificial Sequence
  Synthetic peptide
  MOD_RES (2)..(2): Xaa is Aib
  MOD_RES (10)..(10): Covelently bound to C16 fatty acyl group via Ala-Ala spacer
  MOD_RES (16)..(16): Xaa is Aib
  MOD_RES (29)..(29): AMIDATION
HXQGTFTSDKSKYLDXRRAQDFVCWLMNT

SEQ ID NO: 916 - protein, 30 aa, Artificial Sequence; identical to SEQ ID NO: 581
  Synthetic peptide
  MOD_RES (2)..(2): D-serine, D-alanine, valine, amino n-butyric acid, glycine, N-methyl serine, aminoisobutyric acid
  MOD_RES (30)..(30): Acylated with a C14 fatty acyl group
  MOD_RES (30)..(30): AMIDATION

SEQ ID NO: 917 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with a C14 fatty acyl group
  MOD_RES (29)..(29): AMIDATION
HXQGTFTSDKSKYLDERRAKDFVQWLMNT

SEQ ID NO: 918 - protein, 30 aa, Artificial Sequence; identical to SEQ ID NO: 581
  Synthetic peptide
  MOD_RES (2)..(2): D-serine, D-alanine, valine, amino n-butyric acid, glycine, N-methyl serine, aminoisobutyric acid
  MOD_RES (30)..(30): Acylated with a C16 fatty acyl group
  MOD_RES (30)..(30): AMIDATION

SEQ ID NO: 919 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with a C16 fatty acyl group
  MOD_RES (29)..(29): AMIDATION
HXQGTFTSDKSKYLDERRAKDFVQWLMNT

SEQ ID NO: 920 - protein, 29 aa, Artificial Sequence
  Synthetic Polypeptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDEQAAKEFIAWLMNT

SEQ ID NO: 921 - protein, 29 aa, Artificial Sequence
  Synthetic Polypeptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDEQAAKEFIAWLMNT

SEQ ID NO: 922 - protein, 29 aa, Artificial Sequence
  Synthetic Polypeptide
  MISC_FEATURE: c-term amidation
  MOD_RES (1)..(1): (Des-amino)His
XSQGTFTSDYSKYLDEQAAKEFIAWLVKG

SEQ ID NO: 923 - protein, 29 aa, Artificial Sequence
  Synthetic Polypeptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDEQAAKEFIAWLVKG

SEQ ID NO: 924 - protein, 29 aa, Artificial Sequence
  Synthetic Polypeptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDEQAAKEFIAWLVKG

SEQ ID NO: 925 - protein, 29 aa, Artificial Sequence
  Synthetic Polypeptide
  MOD_RES (2)..(2): Aminoisobutyric acid
  MISC_FEATURE (29)..(29): c-term amidation
HXQGTFTSDYSKYLDERRAQDFVQWLMNT

SEQ ID NO: 926 - protein, 29 aa, Artificial Sequence
  Synthetic Polypeptide
  MISC_FEATURE: c-term amidation
  MOD_RES (2)..(2): Aminoisobutyric acid
  MISC_FEATURE (16)..(20): Lactam ring between side chains at positions 16 and 20
HXQGTFTSDYSKYLDERRAKDFVQWLMNT

SEQ ID NO: 927 - protein, 29 aa, Artificial Sequence
  Synthetic Polypeptide
  MISC_FEATURE: c-term amidation
  MOD_RES (2)..(2): Aminoisobutyric acid
  MISC_FEATURE (16)..(20): Lactam ring between side chains at positions 16 and 20
HXQGTFTSDYSKYLDERRAKDFVQWLMNT

SEQ ID NO: 928 - protein, 29 aa, Artificial Sequence
  Synthetic Polypeptide
  MISC_FEATURE: c-term amidation
  MOD_RES (2)..(2): Aminoisobutyric acid
  MISC_FEATURE (12)..(16): Lactam ring between side chains at positions 12 and 16
HXQGTFTSDYSKYLDERRAQDFVQWLMNT

SEQ ID NO: 929 - protein, 29 aa, Artificial Sequence
  Synthetic Polypeptide
  MISC_FEATURE: c-term amidation
  MOD_RES (2)..(2): Aminoisebutyric acid
  MISC_FEATURE (12)..(16): Lactam ring between side chains at positions 12 and 16
HXQGTFTSDYSKYLDERRAKDFVQWLMNT

SEQ ID NO: 930 - protein, 29 aa, Artificial Sequence
  Synthetic Polypeptide
  MISC_FEATURE: c-term amidation
  MOD_RES (2)..(2): Aminoisobutyric acid
  MISC_FEATURE (16)..(20): Lactam ring between side chains at positions 16 and 20
HXQGTFTSDYSKYLDKRRAEDFVQWLMNT

SEQ ID NO: 931 - protein, 29 aa, Artificial Sequence
  Synthetic Polypeptide
  MISC_FEATURE: c-term amidation
  MOD_RES (2)..(2): Aminoisobutyric acid
HXQGTFTSDYSKYLDERAAKDFVQWLMNT

SEQ ID NO: 932 - protein, 29 aa, Artificial Sequence
  Synthetic Polypeptide
  MISC_FEATURE: c-term amidation
  MOD_RES (2)..(2): Aminoisobutyric acid
  MISC_FEATURE (16)..(20): Lactam ring between side chains at positions 16 and 20
HXQGTFTSDYSKYLDERAAKDFVQWLMNT

SEQ ID NO: 933 - protein, 29 aa, Artificial Sequence
  Synthetic Polypeptide
  MISC_FEATURE: c-term amidation
  MOD_RES (2)..(2): Aminoisobutryic acid
  MISC_FEATURE (12)..(16): Lactam ring between side chains at positions 12 and 16
HXQGTFTSDYSKYLDERAAQDFVQWLMNT

SEQ ID NO: 934 - protein, 29 aa, Artificial Sequence
  glucagon analog
  MISC_FEATURE: c-term amidation
  MOD_RES (2)..(2): Aminoisobutryic acid
  MISC_FEATURE (12)..(16): Lactam ring between side chains at positions 12 and 16
HXQGTFTSDYSKYLDERAAKDFVQWLMNT

SEQ ID NO: 935 - protein, 29 aa, Artificial Sequence
  glucagon analog
  MISC_FEATURE: c-term amidation
  MOD_RES (2)..(2): Aminoisobutryic acid
  MISC_FEATURE (16)..(20): Lactam ring between side chains at positions 16 and 20
HXQGTFTSDYSKYLDKRAAEDFVQWLMNT

SEQ ID NO: 936 - protein, 29 aa, Artificial Sequence
  glucagon analog
  MISC_FEATURE: c-term amidation
  MOD_RES (2)..(2): Aminoisobutyric acid
HXQGTFTSDYSKYLDEQAAKEFIAWLMNT

SEQ ID NO: 937 - protein, 29 aa, Artificial Sequence
  glucagon analog
  MISC_FEATURE: c-term amidation
  MOD_RES (2)..(2): Aminoisobutryic acid
  MISC_FEATURE (12)..(16): Lactam ring between side chains at positions 12 and 16
HXQGTFTSDYSKYLDEQAAKEFIAWLMNT

SEQ ID NO: 938 - protein, 29 aa, Artificial Sequence
  glucagon analog
  MISC_FEATURE: c-term amidation
  MOD_RES (2)..(2): Aminoisobutryic acid
  MISC_FEATURE (16)..(20): Lactam ring between side chains at positions 16 and 20
HXQGTFTSDYSKYLDEQAAKEFIAWLMNT

SEQ ID NO: 939 - protein, 29 aa, Artificial Sequence
  glucagon analog
  MISC_FEATURE: c-term amidation
  MOD_RES (2)..(2): Aminoisobutyric acid
HXQGTFTSDYSKYLDEQAAKEFIAWLVKG

SEQ ID NO: 940 - protein, 29 aa, Artificial Sequence
  glucagon analog
  MISC_FEATURE: c-term amidation
  MOD_RES (2)..(2): Aminoisobutyric acid
  MISC_FEATURE (12)..(16): Lactam ring between side chains at positions 12 and 16
HXQGTFTSDYSKYLDEQAAKEFIAWLVKG

SEQ ID NO: 941 - protein, 29 aa, Artificial Sequence
  glucagon analog
  MISC_FEATURE: c-term amidation
  MOD_RES (2)..(2): Aminoisobutyric acid
  MISC_FEATURE (16)..(20): Lactam ring between side chains at positions 16 and 20
HXQGTFTSDYSKYLDEQAAKEFIAWLVKG

SEQ ID NO: 942 - protein, 29 aa, Artificial Sequence
  glucagon analog
  MISC_FEATURE: c-term amidation
  MOD_RES (2)..(2): D-Ala
HXQGTFTSDYSKYLDERRAQDFVQWLMNT

SEQ ID NO: 943 - protein, 29 aa, Artificial Sequence
  glucagon analog
  MISC_FEATURE: c-term amidation
  MOD_RES (2)..(2): D-Ala
HXQGTFTSDYSKYLDERRAKDFVQWLMNT

SEQ ID NO: 944 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDERRAKDFVQWLMNT

SEQ ID NO: 945 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDERRAQDFVQWLMNT

SEQ ID NO: 946 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDERRAKDFVQWLMNT

SEQ ID NO: 947 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDKRRAEDFVQWLMNT

SEQ ID NO: 948 - protein, 29 aa, Artificial Sequence
  glucagon analog
  MISC_FEATURE: c-term amidation
  MOD_RES (2)..(2): D-Ala
HXQGTFTSDYSKYLDERAAKDFVQWLMNT

SEQ ID NO: 949 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDERAAKDFVQWLMNT

SEQ ID NO: 950 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDERAAQDFVQWLMNT

SEQ ID NO: 951 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDERAAKDFVQWLMNT

SEQ ID NO: 952 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDKRAAEDFVQWLMNT

SEQ ID NO: 953 - protein, 29 aa, Artificial Sequence
  glucagon analog
  MISC_FEATURE: c-term amidation
  MOD_RES (2)..(2): D-Ala
HXQGTFTSDYSKYLDEQAAKEFIAWLMNT

SEQ ID NO: 954 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDEQAAKEFIAWLMNT

SEQ ID NO: 955 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDEQAAKEFIAWLMNT

SEQ ID NO: 956 - protein, 29 aa, Artificial Sequence
  glucagon analog
  MISC_FEATURE: c-term amidation
  MOD_RES (2)..(2): D-Ala
HXQGTFTSDYSKYLDEQAAKEFIAWLVKG

SEQ ID NO: 957 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDEQAAKEFIAWLVKG

SEQ ID NO: 958 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDEQAAKEFIAWLVKG

SEQ ID NO: 959 - protein, 29 aa, Artificial Sequence
  glucagon analog
  MISC_FEATURE: c-term amidation
HSEGTFTSDYSKYLDERRAQDFVQWLMNT

SEQ ID NO: 960 - protein, 29 aa, Artificial Sequence
  glucagon analog
  MISC_FEATURE: c-term amidation
HSEGTFTSDYSKYLDERRAKDFVQWLMNT

SEQ ID NO: 961 - protein, 29 aa, Artificial Sequence
  glucagon analog
  MISC_FEATURE: c-term amidation
  MISC_FEATURE (16)..(20): Lactam ring between side chains at positions 16 and 20
HSEGTFTSDYSKYLDERRAKDFVQWLMNT

SEQ ID NO: 962 - protein, 29 aa, Artificial Sequence
  glucagon analog
  MISC_FEATURE: c-term amidation
  MISC_FEATURE (12)..(16): Lactam ring between side chains at positions 12 and 16
HSEGTFTSDYSKYLDERRAQDFVQWLMNT

SEQ ID NO: 963 - protein, 29 aa, Artificial Sequence
  glucagon analog
  MISC_FEATURE: c-term amidation
HSEGTFTSDYSKYLDERAAKDFVQWLMNT

SEQ ID NO: 964 - protein, 29 aa, Artificial Sequence
  glucagon analog
  MISC_FEATURE: c-term amidation
  MISC_FEATURE (16)..(20): Lactam ring between side chains at positions 16 and 20
HSEGTFTSDYSKYLDERAAKDFVQWLMNT

SEQ ID NO: 965-1000 - skipped (36 entries)

SEQ ID NO: 1001 - protein, 29 aa, Homo sapiens
  MISC_FEATURE: Wild type glucagon
HSQGTFTSDYSKYLDSRRAQDFVQWLMNT

SEQ ID NO: 1002 - protein, 31 aa, Homo sapiens; identical to SEQ ID NO: 703
  MISC_FEATURE (1)..(31): GLP-1(7-37)

SEQ ID NO: 1003 - protein, 30 aa, Artificial sequence; identical to SEQ ID NO: 704
  Synthetic polypeptide
  MISC_FEATURE (1)..(30): GLP-1(7-36) amidated
  MISC_FEATURE (30)..(30): C-terminal amidation

SEQ ID NO: 1004 - protein, 42 aa, Homo sapiens; identical to SEQ ID NO: 707
  mat_peptide (1)..(42): gastric inhibitory polypeptide

SEQ ID NO: 1005 - protein, 29 aa, Artificial sequence
  Synthetic polypeptide
  MISC_FEATURE: Analog 61
  MISC_FEATURE (16)..(20): Lactam bridge between residues 16 and 20.
HSQGTFTSDYSKYLDEIHQKEFIAWLMNT

SEQ ID NO: 1006 - protein, 29 aa, Artificial sequence
  Synthetic polypeptide
  MISC_FEATURE: Analog 62
  MISC_FEATURE (16)..(20): Lactam bridge between residues 16 and 20.
HSQGTFTSDYSIYLDEIHQKEFIAWLMNT

SEQ ID NO: 1007 - protein, 29 aa, Artificial sequence
  Synthetic polypeptide
  MISC_FEATURE: Analog 63
  MISC_FEATURE (12)..(16): Lactam bridge between residues 12 and 16.
HSQGTFTSDYSKYLDEIHQKEFIAWLMNT

SEQ ID NO: 1008 - protein, 29 aa, Artificial sequence
  Synthetic polypeptide
  MISC_FEATURE: Analog 66
HSQGTFTSDYSKYLDEIHQKEFIAWLLAQ

SEQ ID NO: 1009 - protein, 29 aa, Artificial sequence
  Synthetic polypeptide
  MISC_FEATURE: Analog 68
HSQGTFTSDYSKYLDKIHQEEFIAWLMNT

SEQ ID NO: 1010 - protein, 29 aa, Artificial sequence
  Synthetic polypeptide
  MISC_FEATURE: Analog 69
  MISC_FEATURE (16)..(20): Lactam bridge between residues 16 and 20
HSQGTFTSDYSKYLDKIHQEEFIAWLMNT

SEQ ID NO: 1011 - protein, 29 aa, Artificial sequence
  Synthetic polypeptide
  MISC_FEATURE: Analog 84
  MISC_FEATURE (16)..(20): Lactam bridge between residues 16 and 20
HSQGTFTSDYSIYLDEIHQKEFICWLLAQ

SEQ ID NO: 1012 - protein, 29 aa, Artificial sequence
  Synthetic polypeptide
  MISC_FEATURE: Analog 85
  MISC_FEATURE (16)..(20): Lactam bridge between residues 16 and 20
  MISC_FEATURE (24)..(24): PEG (20kDa) covalently attached to Cysteine
HSQGTFTSDYSIYLDEIHQKEFICWLLAQ

SEQ ID NO: 1013 - protein, 29 aa, Artificial sequence
  Synthetic polypeptide
  MISC_FEATURE: Analog 92
HSQGTFTSDYSIYLDEKHQKEFIAWLLAQ

SEQ ID NO: 1014 - protein, 29 aa, Artificial sequence
  Synthetic polypeptide
  MISC_FEATURE: Analog 93
  MISC_FEATURE (16)..(20): Lactam bridge between residues 16 and 20
  MISC_FEATURE (17)..(21): Lactam bridge between residues 17 and 21
HSQGTFTSDYSIYLDEKHQKEFIAWLLAQ

SEQ ID NO: 1015 - protein, 29 aa, Artificial sequence
  Synthetic polypeptide
  MISC_FEATURE: Analog 95
  MISC_FEATURE (16)..(20): Lactam bridge between residues 16 and 20
HAEGTFISDYSIAMDEIHQKDFVNWLLAQ

SEQ ID NO: 1016 - protein, 29 aa, Artificial sequence
  Synthetic polypeptide
  MISC_FEATURE: Analog 96
  MISC_FEATURE (16)..(20): Lactam bridge between residues 16 and 20
YAEGTFISDYSIAMDEIHQKDFVNWLLAQ

SEQ ID NO: 1017 - protein, 29 aa, Artificial sequence
  Synthetic polypeptide
  MISC_FEATURE: Analog 97
  MISC_FEATURE (16)..(20): Lactam bridge between residues 16 and 20
HAEGTFTSDYSIYMDEIHQKDFVNWLLAQ

SEQ ID NO: 1018 - protein, 29 aa, Artificial sequence
  Synthetic polypeptide
  MISC_FEATURE: Analog 98
  MISC_FEATURE (16)..(20): Lactam bridge between residues 16 and 20
YAEGTFTSDYSIYMDEIHQKDFVNWLLAQ

SEQ ID NO: 1019 - protein, 42 aa, Artificial sequence
  Synthetic polypeptide
  MISC_FEATURE: Analog 99
YAEGTFISDYSIAMDKIHQQDFVNWLLAQKGKKNWLKHNITQ

SEQ ID NO: 1020 - protein, 42 aa, Artificial sequence
  Synthetic polypeptide
  MISC_FEATURE: Analog 100
  MOD_RES (2)..(2): Xaa is Aib
YXEGTFISDYSIAMDKIHQQDFVNWLLAQKGKKNWLKHNITQ

SEQ ID NO: 1021 - protein, 42 aa, Artificial sequence
  Synthetic polypeptide
  MISC_FEATURE: Analog 101
YAPGTFISDYSIAMDKIHQQDFVNWLLAQKGKKNWLKHNITQ

SEQ ID NO: 1022 - protein, 42 aa, Artificial sequence
  Synthetic polypeptide
  MISC_FEATURE: Analog 102
  MOD_RES (2)..(2): Xaa is Aib
YXEGTFISDYSIAMDKIHQQDFVCWLLAQKGKKNWLKHNITQ

SEQ ID NO: 1023 - protein, 42 aa, Artificial sequence
  Synthetic polypeptide
  MISC_FEATURE: Analog 104
YAPGTFISDYSIAMDKIHQQDFVCWLLAQKGKKNWLKHNITQ

SEQ ID NO: 1024 - protein, 42 aa, Artificial sequence; identical to SEQ ID NO: 1023
  Synthetic polypeptide
  MISC_FEATURE: Analog 105
  MISC_FEATURE (24)..(24): PEG (40kDa) attached to Cysteine

SEQ ID NO: 1025 - protein, 29 aa, Artificial sequence
  Synthetic polypeptide
  MISC_FEATURE: Analog 106
YAEGTFISDYSIAMDKIHQQDFVNWLLAQ

SEQ ID NO: 1026 - protein, 29 aa, Artificial sequence
  Synthetic polypeptide
  MISC_FEATURE: Analog 107
  MISC_FEATURE (16)..(20): Lactam bridge between residues 16 and 20
HSQGTFISDYSKYLDEIHQKEFIAWLMNT

SEQ ID NO: 1027 - protein, 29 aa, Artificial sequence
  Synthetic polypeptide
  MISC_FEATURE: Analog 108
  MISC_FEATURE (16)..(20): Lactam bridge between residues 16 and 20
HSQGTFISDYSKALDEIHQKEFIAWLMNT

SEQ ID NO: 1028 - protein, 29 aa, Artificial sequence
  Synthetic polypeptide
  MISC_FEATURE: Analog 109
  MISC_FEATURE (16)..(20): Lactam bridge between residues 16 and 20
YSQGTFTSDYSKYLDEIHQKDFVNWLLAQ

SEQ ID NO: 1029 - protein, 29 aa, Artificial sequence
  Synthetic polypeptide
  MISC_FEATURE: Analog 110
  MISC_FEATURE (16)..(20): Lactam bridge between residues 16 and 20
YSQGTFTSDYSIYLDEIHQKDFVNWLLAQ

SEQ ID NO: 1030 - protein, 29 aa, Artificial sequence
  Synthetic polypeptide
  MISC_FEATURE: Analog 111
  MISC_FEATURE (16)..(20): Lactam bridge between residues 16 and 20
HSQGTFTSDYSKYLDEIHQKDFVNWLLAQ

SEQ ID NO: 1031 - protein, 24 aa, Artificial sequence
  Synthetic polypeptide
  MISC_FEATURE: Analog 113
  MOD_RES (1)..(1): Xaa is 3-phenyllactic acid
  MISC_FEATURE (11)..(15): Lactam bridge between residues 11 and 15
XISDYSIAMDEIHQKDFVNWLLAQ

SEQ ID NO: 1032 - protein, 24 aa, Artificial sequence
  Synthetic polypeptide
  MISC_FEATURE: Analog 114
  MOD_RES (1)..(1): Xaa is 3-phenyllactic acid
  MISC_FEATURE (11)..(15): Lactam bridge between residues 11 and 15
XTSDYSKYLDEIHQKDFVNWLLAQ

SEQ ID NO: 1033 - protein, 39 aa, Artificial sequence
  Synthetic polypeptide
  MISC_FEATURE: Analog 115
  MISC_FEATURE (16)..(20): Lactam bridge between residues 16 and 20
HSQGTFTSDYSKYLDEIHQKDFVNWLLAGGPSSGAPPPS

SEQ ID NO: 1034 - protein, 39 aa, Artificial sequence
  Synthetic polypeptide
  MISC_FEATURE: Analog 116
  MISC_FEATURE (16)..(20): Lactam bridge between residues 16 and 20
YSQGTFTSDYSKYLDEIHQKDFVNWLLAGGPSSGAPPPS

SEQ ID NO: 1035 - protein, 29 aa, Artificial sequence
  Synthetic polypeptide
  MISC_FEATURE: Analog 118
  MISC_FEATURE (16)..(20): Lactam bridge between residues 16 and 20
YSQGTFTSDYSKYLDEIHQKEFVNWLLAQ

SEQ ID NO: 1036 - protein, 39 aa, Artificial sequence
  Synthetic polypeptide
  MISC_FEATURE: Analog 120
  MISC_FEATURE (16)..(20): Lactam bridge between residues 16 and 20
YSQGTFTSDYSKYLDEQAAKEFIAWLMNGGPSSGAPPPS

SEQ ID NO: 1037 - protein, 29 aa, Artificial sequence
  Synthetic polypeptide
  MISC_FEATURE: Analog 124
  MISC_FEATURE (16)..(20): Lactam bridge between residues 16 and 20
HSQGTFTSDYSIYMDEIHQKDFVNWLLAQ

SEQ ID NO: 1038 - protein, 29 aa, Artificial sequence
  Synthetic polypeptide
  MISC_FEATURE: Analog 125
  MISC_FEATURE (16)..(20): Lactam bridge between residues 16 and 20
YSQGTFTSDYSIYMDEIHQKDFVNWLLAQ

SEQ ID NO: 1039 - protein, 39 aa, Artificial sequence
  Synthetic polypeptide
  MISC_FEATURE: Analog 127
  MISC_FEATURE (16)..(20): Lactam bridge between residues 16 and 20
YSQGTFTSDYSKYLDEQAAKEFVNWLLAGGPSSGAPPPS

SEQ ID NO: 1040 - protein, 39 aa, Artificial sequence
  Synthetic polypeptide
  MISC_FEATURE: Analog 128
  MISC_FEATURE (16)..(20): Lactam bridge between residues 16 and 20
HSQGTFTSDYSKYLDEIHQKDFIAWLMNGGPSSGAPPPS

SEQ ID NO: 1041 - protein, 39 aa, Artificial sequence
  Synthetic polypeptide
  MISC_FEATURE: Analog 129
  MISC_FEATURE (16)..(20): Lactam bridge between residues 16 and 20
YSQGTFTSDYSKYLDEIHQKDFIAWLMNGGPSSGAPPPS

SEQ ID NO: 1042 - protein, 39 aa, Artificial sequence
  Synthetic polypeptide
  MISC_FEATURE: Analog 139
  MISC_FEATURE (16)..(20): Lactam bridge between residues 16 and 20
YSQGTFTSDYSKYLDEQAAKEFIAWLLAGGPSSGAPPPS

SEQ ID NO: 1043 - protein, 39 aa, Artificial sequence
  Synthetic polypeptide
  MISC_FEATURE: Analog 140
  MISC_FEATURE (16)..(20): Lactam bridge between residues 16 and 20
YSQGTFTSDYSIYLDEQAAKEFVNWLLAGGPSSGAPPPS

SEQ ID NO: 1044 - protein, 39 aa, Artificial sequence
  Synthetic polypeptide
  MISC_FEATURE: Analog 141
  MISC_FEATURE (16)..(20): Lactam bridge between residuess 16 and 20
YSQGTFTSDYSKYMDEQAAKEFVNWLLAGGPSSGAPPPS

SEQ ID NO: 1045 - protein, 39 aa, Artificial sequence
  Synthetic polypeptide
  MISC_FEATURE: Analog 142
  MISC_FEATURE (16)..(20): Lactam bridge between residues 16 and 20
YAEGTFTSDYSIYMDEQAAKEFVNWLLAGGPSSGAPPPS

SEQ ID NO: 1046 - protein, 39 aa, Artificial sequence
  Synthetic polypeptide
  MISC_FEATURE: Analog 143
  MISC_FEATURE (16)..(20): Lactam bridge between residues 16 and 20
YSQGTFTSDYSKYLDERRAKEFVNWLLAGGPSSGAPPPS

SEQ ID NO: 1047 - protein, 39 aa, Artificial sequence
  Synthetic polypeptide
  MISC_FEATURE: Analog 144
  MISC_FEATURE (16)..(20): Lactam bridge between residues 16 and 20
YAQGTFTSDYSIYMDEQAAKEFVNWLLAGGPSSGAPPPS

SEQ ID NO: 1048 - protein, 39 aa, Artificial sequence
  Synthetic polypeptide
  MISC_FEATURE: Analog 145
  MISC_FEATURE (16)..(20): Lactam bridge between residues 16 and 20
YAQGTFISDYSKYLDEQAAKEFVNWLLAGGPSSGAPPPS

SEQ ID NO: 1049 - protein, 39 aa, Artificial sequence; identical to SEQ ID NO: 1048
  Synthetic polypeptide
  MISC_FEATURE: Analog 146
  MISC_FEATURE (16)..(20): Lactam bridge between residues 16 and 20

SEQ ID NO: 1050 - protein, 39 aa, Artificial sequence
  Synthetic polypeptide
  MISC_FEATURE: Analog 147
  MISC_FEATURE (16)..(20): Lactam bridge between residues 16 and 20
YSQGTFTSDYSIYLDEQAAKEFIAWLLAGGPSSGAPPPS

SEQ ID NO: 1051 - protein, 39 aa, Artificial sequence
  Synthetic polypeptide
  MISC_FEATURE: Analog 148
  MISC_FEATURE (16)..(20): Lactam bridge between residues 16 and 20
YSEGTFTSDYSIYLDEQAAKEFIAWLLAGGPSSGAPPPS

SEQ ID NO: 1052 - protein, 39 aa, Artificial sequence
  Synthetic polypeptide
  MISC_FEATURE: Analog 149
  MISC_FEATURE (16)..(20): Lactam bridge between residues 16 and 20
YAEGTFTSDYSIYLDEQAAKEFVNWLLAGGPSSGAPPPS

SEQ ID NO: 1053 - protein, 39 aa, Artificial sequence
  Synthetic polypeptide
  MISC_FEATURE: Analog 150
  MISC_FEATURE (16)..(20): Lactam bridge between residues 16 and 20
YSQGTFISDYSIYLDEQAAKEFVNWLLAGGPSSGAPPPS

SEQ ID NO: 1054 - protein, 39 aa, Artificial sequence; identical to SEQ ID NO: 1042
  Synthetic polypeptide
  MISC_FEATURE: Analog 151
  MISC_FEATURE (16)..(20): Lactam bridge between residues 16 and 20

SEQ ID NO: 1055 - protein, 39 aa, Artificial sequence
  Synthetic polypeptide
  MISC_FEATURE: Analog 152
  MOD_RES (2)..(2): Xaa is Aib
  MISC_FEATURE (16)..(20): Lactam bridge between residues 16 and 20
YXQGTFTSDYSIYLDEQAAKEFVNWLLAGGPSSGAPPPS

SEQ ID NO: 1056 - protein, 39 aa, Artificial sequence
  Synthetic polypeptide
  MISC_FEATURE: Analog 154
  MOD_RES (1)..(1): Xaa is hippuric acid
  MISC_FEATURE (16)..(20): Lactam bridge between residues 16 and 20
XSQGTFTSDYSIYLDEQAAKEFVNWLLAGGPSSGAPPPS

SEQ ID NO: 1057 - protein, 39 aa, Artificial sequence; identical to SEQ ID NO: 1039
  Synthetic polypeptide
  MISC_FEATURE: Analog 155
  MISC_FEATURE (12)..(16): Lactam bridge between residues 12 and 16

SEQ ID NO: 1058 - protein, 39 aa, Artificial sequence
  Synthetic polypeptide
  MISC_FEATURE: Analog 156
  MISC_FEATURE (20)..(24): Lactam bridge between residues 20 and 24
YSQGTFTSDYSIYLDEQAAKEFVEWLLAGGPSSGAPPPS

SEQ ID NO: 1059 - protein, 39 aa, Artificial sequence
  Synthetic polypeptide
  MISC_FEATURE: Analog 157
  MISC_FEATURE (24)..(28): Lactam bridge between residues 24 and 28
YSQGTFTSDYSIYLDEQAAKEFVEWLLKGGPSSGAPPPS

SEQ ID NO: 1060 - protein, 39 aa, Artificial sequence
  Synthetic polypeptide
  MISC_FEATURE: Analog 158
  MOD_RES (2)..(2): Xaa is Aib
  MISC_FEATURE (16)..(20): Lactam bridge between residues 16 and 20
YXQGTFTSDYSIYLDEQAAKEFVCWLLAGGPSSGAPPPS

SEQ ID NO: 1061 - protein, 39 aa, Artificial sequence
  Synthetic polypeptide
  MISC_FEATURE: Analog 162
  MOD_RES (2)..(2): Xaa is Aib
  MISC_FEATURE (16)..(20): Lactam bridge between residues 16 and 20
YXQGTFTSDYSYYLDEQAVKEFVNWLIAGGPSSGAPPPS

SEQ ID NO: 1062 - protein, 29 aa, Artificial sequence
  Synthetic polypeptide
  MISC_FEATURE: Analog 163
  MISC_FEATURE (16)..(20): Lactam bridge between residues 16 and 20
YSQGTFTSDYSIYLDEQAAKEFVNWLLAG

SEQ ID NO: 1063 - protein, 29 aa, Artificial sequence
  Synthetic polypeptide
  MISC_FEATURE: Analog 164
  MOD_RES (2)..(2): Xaa is Aib
  MISC_FEATURE (16)..(20): Lactam bridge between residues 16 and 20
YXQGTFTSDYSIYLDEQAAKEFVNWLLAG

SEQ ID NO: 1064 - protein, 40 aa, Artificial sequence
  Synthetic polypeptide
  MISC_FEATURE: Analog 165
  MOD_RES (2)..(2): Xaa is Aib
  MISC_FEATURE (16)..(20): Lactam bridge between residues 16 and 20
YXQGTFTSDYSIYLDEQAAKEFVNWLLAGGPSSGAPPPSC

SEQ ID NO: 1065 - protein, 40 aa, Artificial sequence; identical to SEQ ID NO: 1064
  Synthetic polypeptide
  MISC_FEATURE: Analog 166
  MOD_RES (2)..(2): Xaa is d-alanine
  MISC_FEATURE (16)..(20): Lactam bridge between residues 16 and 20

SEQ ID NO: 1066 - protein, 39 aa, Artificial sequence
  Synthetic polypeptide
  MISC_FEATURE: Analog 167
  MISC_FEATURE (17)..(20): Lactam bridge between residues 17 and 20
YSQGTFTSDYSIYLDEEAAKEFVNWLLAGGPSSGAPPPS

SEQ ID NO: 1067 - protein, 39 aa, Artificial sequence
  Synthetic polypeptide
  MISC_FEATURE: Analog 168
  MISC_FEATURE (18)..(21): Lactam bridge between residues 18 and 21
YSQGTFTSDYSIYLDEQKAKEFVNWLLAGGPSSGAPPPS

SEQ ID NO: 1068 - protein, 29 aa, Artificial sequence
  Synthetic polypeptide
  MISC_FEATURE: Analog 169
  MOD_RES (2)..(2): Xaa is Aib
  MISC_FEATURE (16)..(20): Lactam bridge between residues 16 and 20
YXQGTFTSDYSIYLDEQAAKEFVCWLLAG

SEQ ID NO: 1069 - protein, 40 aa, Artificial sequence; identical to SEQ ID NO: 1064
  Synthetic polypeptide
  MISC_FEATURE: Analog 170
  MOD_RES (2)..(2): Xaa is Aib
  MISC_FEATURE (16)..(20): Lactam bridge between residues 16 and 20
  MISC_FEATURE (40)..(40): PEG (40kDa) covalently attached to Cysteine

SEQ ID NO: 1070 - protein, 29 aa, Artificial sequence
  Synthetic polypeptide
  MISC_FEATURE: Analog 172
  MOD_RES (2)..(2): Xaa is Aib
  MISC_FEATURE (16)..(20): Lactam bridge between residues 16 and 20
  MISC_FEATURE (24)..(24): PEG (40kDa) covalently attached to Cysteine
YXQGTFTSDYSIYLDEQAAKEFVCWLLAG

SEQ ID NO: 1071 - protein, 40 aa, Artificial sequence; identical to SEQ ID NO: 761
  Synthetic polypeptide
  MISC_FEATURE: Analog 174
  MOD_RES (2)..(2): Xaa is Aib
  MISC_FEATURE (16)..(20): Lactam bridge between residues 16 and 20

SEQ ID NO: 1072 - protein, 39 aa, Artificial sequence; identical to SEQ ID NO: 1060
  Synthetic polypeptide
  MISC_FEATURE: Analog 175
  MOD_RES (2)..(2): Xaa is Aib
  MISC_FEATURE (16)..(20): Lactam bridge between residues 16 and 20
  MISC_FEATURE (24)..(24): PEG (40kDa) covalently attached to Cysteine

SEQ ID NO: 1073 - protein, 40 aa, Artificial sequence
  Synthetic polypeptide
  MISC_FEATURE: Analog 176
  MOD_RES (2)..(2): Xaa is Aib
  MISC_FEATURE (16)..(20): Lactam bridge between residues 16 and 20
YXQGTFISDYSIYLDEQAAKEFVNWLLAGGPSSGAPPPSC

SEQ ID NO: 1074 - protein, 29 aa, Artificial sequence
  Synthetic polypeptide
  MISC_FEATURE: Analog 177
  MOD_RES (2)..(2): Xaa is Aib
  MISC_FEATURE (16)..(20): Lactam bridge between residues 16 and 20
YXQGTFISDYSIYLDEQAAKEFVCWLLAG

SEQ ID NO: 1075 - protein, 40 aa, Artificial sequence; identical to SEQ ID NO: 761
  Synthetic polypeptide
  MISC_FEATURE: Analog 178
  MOD_RES (2)..(2): Xaa is Aib
  MISC_FEATURE (16)..(20): Lactam bridge between residues 16 and 20
  MISC_FEATURE (40)..(40): PEG (40kDa) covalently attached to Cysteine

SEQ ID NO: 1076 - protein, 29 aa, Artificial sequence
  Synthetic polypeptide
  MISC_FEATURE: Analog 179
  MOD_RES (2)..(2): Xaa is Aib
  MISC_FEATURE (16)..(20): Lactam bridge between residues 16 and 20
  MISC_FEATURE (24)..(24): PEG (40kDa) covalently attached to Cysteine
YXQGTFISDYSIYLDEQAAKEFVCWLLAG

SEQ ID NO: 1077 - protein, 40 aa, Artificial sequence; identical to SEQ ID NO: 1073
  Synthetic polypeptide
  MISC_FEATURE: Analog 182
  MOD_RES (2)..(2): Xaa is Aib
  MISC_FEATURE (16)..(20): Lactam bridge between residues 16 and 20
  MISC_FEATURE (40)..(40): PEG (40kDa) covalently attached to Cysteine

SEQ ID NO: 1078 - protein, 29 aa, Artificial sequence
  Synthetic polypeptide
  MISC_FEATURE: Analog 186
  MOD_RES (2)..(2): Xaa is Aib
  MISC_FEATURE (16)..(20): Lactam bridge between residues 16 and 20
  MISC_FEATURE (24)..(24): PEG (40kDa) covalently attached to Cysteine
YXQGTFTSDYSIYLDEQAAKEFVCWLMNG

SEQ ID NO: 1079 - protein, 39 aa, Artificial sequence; identical to SEQ ID NO: 1055
  Synthetic polypeptide
  MISC_FEATURE: Analog 191
  MOD_RES (2)..(2): Xaa is Aib

SEQ ID NO: 1080 - protein, 34 aa, Artificial sequence
  Synthetic polypeptide
  MISC_FEATURE: Analog 192
FTSDYSIYLDEQAAKEFVNWLLAGGPSSGAPPPS

SEQ ID NO: 1081 - protein, 38 aa, Artificial sequence
  Synthetic polypeptide
  MISC_FEATURE: Analog 194
  MOD_RES (1)..(1): Xaa is Aib
XQGTFTSDYSIYLDEEAVRLFVNWLLAGGPSSGAPPPS

SEQ ID NO: 1082 - protein, 26 aa, Artificial sequence
  Synthetic polypeptide
  MISC_FEATURE: Analog 197
  MISC_FEATURE (13)..(17): Lactam bridge between residues 13 and 17
GTFTSDYSIYLDEQAAKEFVNWLLAG

SEQ ID NO: 1083 - protein, 28 aa, Artificial sequence
  Synthetic polypeptide
  MISC_FEATURE: Analog 198
  MOD_RES (1)..(1): Xaa is Aib
  MISC_FEATURE (15)..(19): Lactam bridge between residues 15 and 19
XQGTFTSDYSIYLDEQAAKEFVNWLLAG

SEQ ID NO: 1084 - protein, 40 aa, Artificial sequence
  Synthetic polypeptide
  MISC_FEATURE: Analog 199
  MOD_RES (2)..(2): Xaa is Aib
  MISC_FEATURE (16)..(20): Lactam bridge between residues 16 and 20
YXQGTFVSDYSIYLDEQAAKEFVNWLLAGGPSSGAPPPSC

SEQ ID NO: 1085 - protein, 40 aa, Artificial sequence
  Synthetic polypeptide
  MISC_FEATURE: Analog 200
  MOD_RES (2)..(2): Xaa is Aib
  MISC_FEATURE (16)..(20): Lactam bridge between residues 16 and 20
  MOD_RES (27)..(27): Xaa is Nle
YXQGTFTSDYSIYLDEQAAKEFVNWLXAGGPSSGAPPPSC

SEQ ID NO: 1086 - protein, 39 aa, Artificial sequence
  Synthetic polypeptide
  MISC_FEATURE: Analog 201
  MOD_RES (2)..(2): Xaa is Aib
YXQGTFTSDYSIYLDEEAVRLFVNWLLAGGPSSGAPPPS

SEQ ID NO: 1087 - protein, 40 aa, Artificial sequence; identical to SEQ ID NO: 1084
  Synthetic polypeptide
  MISC_FEATURE: Analog 202
  MOD_RES (2)..(2): Xaa is Aib
  MISC_FEATURE (16)..(20): Lactam bridge between residues 16 and 20
  MISC_FEATURE (40)..(40): PEG (40kDa) covalently attached to Cysteine

SEQ ID NO: 1088 - protein, 40 aa, Artificial sequence; identical to SEQ ID NO: 1085
  Synthetic polypeptide
  MISC_FEATURE: Analog 203
  MOD_RES (2)..(2): Xaa is Aib
  MISC_FEATURE (16)..(20): Lactam bridge between residues 16 and 20
  MOD_RES (27)..(27): Xaa is Nle
  MISC_FEATURE (40)..(40): PEG (40kDa) covalently attached to Cysteine

SEQ ID NO: 1089 - protein, 40 aa, Artificial sequence
  Synthetic polypeptide
  MISC_FEATURE: Analog 204
  MOD_RES (2)..(2): Xaa is Aib
  MISC_FEATURE (16)..(20): Lactam bridge between residues 16 and 20
YXEGTFTSDYSIYLDEQAAKEFVNWLLAGRPSSGAPPPSC

SEQ ID NO: 1090 - protein, 40 aa, Artificial sequence; identical to SEQ ID NO: 1089
  Synthetic polypeptide
  MISC_FEATURE: Analog 205
  MOD_RES (2)..(2): Xaa is Aib
  MISC_FEATURE (16)..(20): Lactam bridge between residues 16 and 20
  MISC_FEATURE (40)..(40): PEG (40kDa) covalently attached to Cysteine

SEQ ID NO: 1091 - protein, 43 aa, Artificial sequence
  Synthetic polypeptide
  MISC_FEATURE: Analog 206
  MOD_RES (2)..(2): Xaa is Aib
  MISC_FEATURE (16)..(20): Lactam bridge between residues 16 and 20
YXEGTFTSDYSIYLDEQAAKEFVNWLLAGKGKKNWLKHNITQC

SEQ ID NO: 1092 - protein, 43 aa, Artificial sequence
  Synthetic polypeptide
  MISC_FEATURE: Analog 207
  MOD_RES (2)..(2): Xaa is Aib
  MISC_FEATURE (16)..(20): Lactam bridge between residues 16 and 20
YXQGTFTSDYSIYLDEQAAKEFVNWLLAGKGKKNWLKHNITQC

SEQ ID NO: 1093 - protein, 43 aa, Artificial sequence; identical to SEQ ID NO: 1091
  Synthetic polypeptide
  MISC_FEATURE: Analog 208
  MOD_RES (2)..(2): Xaa is Aib
  MISC_FEATURE (16)..(20): Lactam bridge between residues 16 and 20
  MISC_FEATURE (43)..(43): PEG (40kDa) covalently attached to Cysteine

SEQ ID NO: 1094 - protein, 40 aa, Artificial sequence
  Synthetic polypeptide
  MISC_FEATURE: Analog 209
  MOD_RES (2)..(2): Xaa is Aib
  MISC_FEATURE (9)..(12): Lactam bridge between residues 9 and 12
  MISC_FEATURE (16)..(20): Lactam bridge between residues 16 and 20
YXQGTFTSEYSKYLDEQAAKEFVNWLLAGGPSSGAPPPSC

SEQ ID NO: 1095 - protein, 10 aa, Artificial sequence
  Synthetic polypeptide
  MISC_FEATURE: CEX
GPSSGAPPPS

SEQ ID NO: 1096 - protein, 11 aa, Artificial sequence
  Synthetic polypeptide
  MISC_FEATURE (1)..(1): Xaa is any amino acid
XGPSSGAPPPS

SEQ ID NO: 1097 - protein, 8 aa, Artificial sequence
  Synthetic polypeptide
KRNRNNIA

SEQ ID NO: 1098 - protein, 4 aa, Artificial sequence
  Synthetic polypeptide
KRNR

SEQ ID NO: 1099 - protein, 40 aa, Artificial Sequence; identical to SEQ ID NO: 760
  Synthetic polypeptide
  MOD_RES (2)..(2): Xaa is Aib
  MOD_RES (20)..(20): Xaa is Aib
  MISC_FEATURE (40)..(40): PEG (40kDa) covalently attached to Cysteine
  MISC_FEATURE (40)..(40): C-terminal amidation

SEQ ID NO: 1100 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): C-terminal amidation

SEQ ID NO: 1101 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 16 Carbon fatty acyl group covalently attached to Lysine
  MISC_FEATURE (40)..(40): C-terminal amidation

SEQ ID NO: 1102 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 14 Carbon fatty acyl group covalently attached Lysine
  MISC_FEATURE (40)..(40): C-terminal amidation

SEQ ID NO: 1103 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 18 Carbon fatty acyl group covalently attached to Lysine
  MISC_FEATURE (40)..(40): C-terminal amidation

SEQ ID NO: 1104 - protein, 40 aa, Artificial Sequence; identical to SEQ ID NO: 756
  Synthetic polypeptide
  MOD_RES (2)..(2): Xaa is Aib
  MOD_RES (20)..(20): Xaa is Aib
  MISC_FEATURE (40)..(40): 14 Carbon fatty acyl group covalently attached to Lysine
  MISC_FEATURE (40)..(40): C-terminal amidation

SEQ ID NO: 1105 - protein, 40 aa, Artificial Sequence; identical to SEQ ID NO: 756
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently attached Lysine
  MISC_FEATURE (40)..(40): C-terminal amidation

SEQ ID NO: 1106 - protein, 40 aa, Artificial Sequence; identical to SEQ ID NO: 756
  Synthetic polypeptide
  MOD_RES (2)..(2): Xaa is Aib
  MOD_RES (20)..(20): Xaa is Aib
  MISC_FEATURE (40)..(40): 18 Carbon fatty acyl group covalently attached to Lysine
  MISC_FEATURE (40)..(40): C-terminal amidation

SEQ ID NO: 1107 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): C-terminal amidation
YXQGTFTSDYSIYLDKQAAXEFVNWLLAGGPSSGAPPPSC

SEQ ID NO: 1108 - protein, 40 aa, Artificial Sequence; identical to SEQ ID NO: 1107
  Synthetic polypeptide
  MOD_RES (2)..(2): Xaa is Aib
  MOD_RES (20)..(20): Xaa is Aib
  MISC_FEATURE (40)..(40): PEG (40kDa) attached to Cysteine
  MISC_FEATURE (40)..(40): C-terminal amidation

SEQ ID NO: 1109 - protein, 40 aa, Artificial Sequence; identical to SEQ ID NO: 760
  Synthetic polypeptide
  MOD_RES (2)..(2): Xaa is Aib
  MOD_RES (20)..(20): Xaa is Aib
  MISC_FEATURE (40)..(40): C-terminal amidation

SEQ ID NO: 1110 - protein, 29 aa, Artificial Sequence
  Synthetic polypeptide
  MOD_RES (2)..(2): Xaa is Aib
  MOD_RES (20)..(20): Xaa is Aib
  MISC_FEATURE (29)..(29): C-terminal amidation
YXQGTFTSDYSIYLDKQAAXEFVCWLLAG

SEQ ID NO: 1111 - protein, 40 aa, Artificial Sequence; identical to SEQ ID NO: 756
  Synthetic polypeptide
  MOD_RES (2)..(2): Xaa is Aib
  MOD_RES (20)..(20): Xaa is Aib
  MISC_FEATURE (40)..(40): C-terminal amidation

SEQ ID NO: 1112 - protein, 29 aa, Artificial Sequence
  Synthetic polypeptide
  MISC_FEATURE (2)..(2): Xaa is Aib
  MISC_FEATURE (20)..(20): Xaa is Aib
YXQGTFTSDYSIYLDKQAAXEFVNWLLAG

SEQ ID NO: 1113 - protein, 39 aa, Artificial Sequence
  Synthetic polypeptide
  MOD_RES (2)..(2): Xaa is Aib
  MOD_RES (20)..(20): Xaa is Aib
  MISC_FEATURE (24)..(24): 14 Carbon fatty acyl group covalently attached to Lysine
  MISC_FEATURE (39)..(39): C-terminal amidation
YXEGTFTSDYSIYLDKQAAXEFVKWLLAGGPSSGAPPPS

SEQ ID NO: 1114 - protein, 39 aa, Artificial Sequence; identical to SEQ ID NO: 1113
  Synthetic polypeptide
  MOD_RES (2)..(2): Xaa is Aib
  MOD_RES (20)..(20): Xaa is Aib
  MISC_FEATURE (24)..(24): 16 Carbon fatty acyl group covalently attached to Lysine
  MISC_FEATURE (39)..(39): C-terminal amidation

SEQ ID NO: 1115 - protein, 39 aa, Artificial Sequence; identical to SEQ ID NO: 1113
  Synthetic polypeptide
  MOD_RES (2)..(2): Xaa is Aib
  MOD_RES (20)..(20): Xaa is Aib
  MISC_FEATURE (24)..(24): 18 Carbon fatty acyl group covalently attached to Lysine
  MISC_FEATURE (39)..(39): C-terminal amidation

SEQ ID NO: 1116 - protein, 39 aa, Artificial Sequence; identical to SEQ ID NO: 1113
  Synthetic polypeptide
  MOD_RES (2)..(2): Xaa is Aib
  MOD_RES (20)..(20): Xaa is Aib
  MISC_FEATURE (39)..(39): C-terminal amidation

SEQ ID NO: 1117 - protein, 39 aa, Artificial Sequence; identical to SEQ ID NO: 758
  Synthetic polypeptide
  MOD_RES (2)..(2): Xaa is Aib
  MISC_FEATURE (10)..(10): 14 Carbon fatty acyl group covalently attached to Lysine
  MOD_RES (20)..(20): Xaa is Aib
  MISC_FEATURE (39)..(39): C-terminal amidation

SEQ ID NO: 1118 - protein, 39 aa, Artificial Sequence; identical to SEQ ID NO: 758
  Synthetic polypeptide
  MOD_RES (2)..(2): Xaa is Aib
  MISC_FEATURE (10)..(10): 16 Carbon fatty acyl group covalently attached to Lysine
  MOD_RES (20)..(20): Xaa is Aib
  MISC_FEATURE (39)..(39): C-terminal amidation

SEQ ID NO: 1119 - protein, 39 aa, Artificial Sequence; identical to SEQ ID NO: 758
  Synthetic polypeptide
  MOD_RES (2)..(2): Xaa is Aib
  MISC_FEATURE (10)..(10): 18 Carbon fatty acyl group covalently attached to Lysine
  MOD_RES (20)..(20): Xaa is Aib
  MISC_FEATURE (39)..(39): C-terminal amidation

SEQ ID NO: 1120 - protein, 39 aa, Artificial Sequence; identical to SEQ ID NO: 758
  Synthetic polypeptide
  MOD_RES (2)..(2): Xaa is Aib
  MOD_RES (20)..(20): Xaa is Aib
  MISC_FEATURE (39)..(39): C-terminal amidation

SEQ ID NO: 1121 - protein, 40 aa, Artificial Sequence
  Synthetic polypeptide
  MOD_RES (2)..(2): Xaa is Aib
  MOD_RES (16)..(16): Xaa is Orn
  MOD_RES (20)..(20): Xaa is Aib
  MISC_FEATURE (40)..(40): C-terminal amidation
YXQGTFTSDYSIYLDXQAAXEFVNWLLAGGPSSGAPPPSC

SEQ ID NO: 1122 - protein, 40 aa, Artificial Sequence; identical to SEQ ID NO: 1121
  Synthetic polypeptide
  MOD_RES (2)..(2): Xaa is Aib
  MOD_RES (16)..(16): Xaa is 2,4-diaminobutyric acid
  MOD_RES (20)..(20): Xaa is Aib
  MISC_FEATURE (40)..(40): C-terminal amidation

SEQ ID NO: 1123 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): 14 Carbon fatty acyl group covalentaly attached to Lysine
  MISC_FEATURE (40)..(40): C-terminal amidation
YXQGTFTSDYSIYLDKQAAXEFVNWLLAGGPSSGAPPPSK

SEQ ID NO: 1124 - protein, 40 aa, Artificial Sequence; identical to SEQ ID NO: 1123
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently attached to Lysine
  MISC_FEATURE (40)..(40): C-terminal amidation

SEQ ID NO: 1125 - protein, 40 aa, Artificial Sequence; identical to SEQ ID NO: 1123
  Synthetic polypeptide
  MOD_RES (2)..(2): Xaa is Aib
  MOD_RES (20)..(20): Xaa is Aib
  MISC_FEATURE (40)..(40): 18 Carbon fatty acyl group covalently attached to Lysine
  MISC_FEATURE (40)..(40): C-terminal amidation

SEQ ID NO: 1126 - protein, 40 aa, Artificial Sequence; identical to SEQ ID NO: 1123
  Synthetic polypeptide
  MOD_RES (2)..(2): Xaa is Aib
  MOD_RES (20)..(20): Xaa is Aib
  MISC_FEATURE (40)..(40): C-terminal amidation

SEQ ID NO: 1127 - protein, 29 aa, Artificial Sequence
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (29)..(29): C-terminal amidation
YXQGTFTSDYSIYLDKQAAXEFVCWLLAG

SEQ ID NO: 1128 - protein, 29 aa, Artificial Sequence
  Synthetic polypeptide
  MOD_RES (2)..(2): Xaa is Aib
  MISC_FEATURE (10)..(10): 14 Carbon fatty acyl group covalently attached to Lysine
  MOD_RES (20)..(20): Xaa is Aib
  MISC_FEATURE (29)..(29): C-terminal amidation
YXEGTFTSDKSIYLDKQAAXEFVNWLLAG

SEQ ID NO: 1129 - protein, 29 aa, Artificial Sequence
  Synthetic polypeptide
  MOD_RES (2)..(2): Xaa is Aib
  MISC_FEATURE (10)..(10): 16 Carbon fatty acyl group covalently attached to Lysine
  MOD_RES (20)..(20): Xaa is Aib
  MISC_FEATURE (29)..(29): C-terminal amidation
YXEGTFTSDKSIYLDKQAAXEFVNWLLAG

SEQ ID NO: 1130 - protein, 29 aa, Artificial Sequence
  Synthetic polypeptide
  MOD_RES (2)..(2): Xaa is Aib
  MISC_FEATURE (10)..(10): 18 Carbon fatty acyl group covalently attached to Lysine
  MOD_RES (20)..(20): Xaa is Aib
  MISC_FEATURE (29)..(29): C-terminal amidation
YXEGTFTSDKSIYLDKQAAXEFVNWLLAG

SEQ ID NO: 1131 - protein, 29 aa, Artificial Sequence
  Synthetic polypeptide
  MOD_RES (2)..(2): Xaa is Aib
  MOD_RES (20)..(20): Xaa is Aib
  MISC_FEATURE (29)..(29): C-terminal amidation
YXEGTFTSDKSIYLDKQAAXEFVNWLLAG

SEQ ID NO: 1132 - protein, 40 aa, Artificial Sequence; identical to SEQ ID NO: 766
  Synthetic polypeptide
  MOD_RES (2)..(2): Xaa is Aib
  MOD_RES (20)..(20): Xaa is Aib
  MISC_FEATURE (40)..(40): 14 Carbon fatty acyl group covalently attached to Lysine
  MISC_FEATURE (40)..(40): C-terminal amidation

SEQ ID NO: 1133 - protein, 40 aa, Artificial Sequence; identical to SEQ ID NO: 766
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently attached to Lysine
  MISC_FEATURE (40)..(40): C-terminal amidation

SEQ ID NO: 1134 - protein, 40 aa, Artificial Sequence; identical to SEQ ID NO: 766
  Synthetic polypeptide
  MOD_RES (2)..(2): Xaa is Aib
  MOD_RES (20)..(20): Xaa is Aib
  MISC_FEATURE (40)..(40): 18 Carbon fatty acyl group covalently attached to Lysine
  MISC_FEATURE (40)..(40): C-terminal amidation

SEQ ID NO: 1135 - protein, 40 aa, Artificial Sequence; identical to SEQ ID NO: 766
  Synthetic polypeptide
  MOD_RES (2)..(2): Xaa is Aib
  MOD_RES (20)..(20): Xaa is Aib
  MISC_FEATURE (40)..(40): C-terminal amidation

SEQ ID NO: 1136 - protein, 40 aa, Artificial Sequence; identical to SEQ ID NO: 766
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 14 Carbon fatty acyl group covalently attached to Lysine
  MISC_FEATURE (40)..(40): C-terminal amidation

SEQ ID NO: 1137 - protein, 40 aa, Artificial Sequence; identical to SEQ ID NO: 766
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 16 Carbon fatty acyl group covalently attached to Lysine
  MISC_FEATURE (40)..(40): C-terminal amidation

SEQ ID NO: 1138 - protein, 40 aa, Artificial Sequence; identical to SEQ ID NO: 766
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 18 Carbon fatty acyl group covalently attached to Lysine
  MISC_FEATURE (40)..(40): C-terminal amidation

SEQ ID NO: 1139 - protein, 40 aa, Artificial Sequence; identical to SEQ ID NO: 766
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): C-terminal amidation

SEQ ID NO: 1140 - protein, 40 aa, Artificial Sequence; identical to SEQ ID NO: 760
  Synthetic polypeptide
  MOD_RES (2)..(2): Xaa is Aib
  MOD_RES (20)..(20): Xaa is Aib
  MISC_FEATURE (40)..(40): PEG (40kDa) covalently attached to Cysteine
  MISC_FEATURE (40)..(40): C-terminal amidation

SEQ ID NO: 1141 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently attached to Lysine
  MISC_FEATURE (40)..(40): C-terminal amidation

SEQ ID NO: 1142 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently attached to Lysine
  MISC_FEATURE (40)..(40): C-terminal amidation
YXQGTFTSDYSIYLDKQAAXEFVCWLMNGGPSSGAPPPSK

SEQ ID NO: 1143 - protein, 40 aa, Artificial Sequence; identical to SEQ ID NO: 1142
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 16 Carbon fatty acyl group covalently attached to Lysine
  MISC_FEATURE (40)..(40): C-terminal amidation

SEQ ID NO: 1144 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (40)..(40): 14 Carbon fatty acyl group covalently attached to Lysine
  MISC_FEATURE (40)..(40): C-terminal amidation

SEQ ID NO: 1145 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (40)..(40): 18 Carbon fatty acyl group covalently attached to Lysine
  MISC_FEATURE (40)..(40): C-terminal amidation

SEQ ID NO: 1146 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (40)..(40): C-terminal amidation

SEQ ID NO: 1147 - protein, 40 aa, Artificial Sequence; identical to SEQ ID NO: 756
  Synthetic polypeptide
  MOD_RES (2)..(2): Xaa is Aib
  MOD_RES (20)..(20): Xaa is Aib
  MISC_FEATURE (40)..(40): 3-SH-propionic acyl group covalently attached to Lysine
  MISC_FEATURE (40)..(40): C-terminal amidation

SEQ ID NO: 1148 - protein, 40 aa, Artificial Sequence; identical to SEQ ID NO: 1123
  Synthetic polypeptide
  MOD_RES (2)..(2): Xaa is Aib
  MOD_RES (20)..(20): Xaa is Aib
  MISC_FEATURE (40)..(40): 8 Carbon fatty acyl group covalently attached to Lysine
  MISC_FEATURE (40)..(40): C-terminal amidation

SEQ ID NO: 1149 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): C-terminal amidation
YXQGTFSSDYSIYLDKQAAXEFVNWLLAGGPSSGAPPPSC

SEQ ID NO: 1150 - protein, 40 aa, Artificial Sequence
  Synthetic polypeptide
  MOD_RES (2)..(2): Xaa is Aib
  MOD_RES (7)..(7): Xaa is 2-aminobutyric acid
  MOD_RES (20)..(20): Xaa is Aib
  MISC_FEATURE (40)..(40): C-terminal amidation
YXQGTFXSDYSIYLDKQAAXEFVNWLLAGGPSSGAPPPSC

SEQ ID NO: 1151 - protein, 40 aa, Artificial Sequence; identical to SEQ ID NO: 766
  Synthetic polypeptide
  MOD_RES (2)..(2): Xaa is Aib
  MOD_RES (20)..(20): Xaa is Aib
  MISC_FEATURE (40)..(40): 8 Carbon fatty acyl group covalently attached to Lysine
  MISC_FEATURE (40)..(40): C-terminal amidation

SEQ ID NO: 1152 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (40)..(40): 8 Carbon fatty acyl group covalently attached to Lysine
  MISC_FEATURE (40)..(40): C-terminal amidation

SEQ ID NO: 1153 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): C-terminal amidation

SEQ ID NO: 1154 - protein, 40 aa, Artificial Sequence
  Synthetic polypeptide
  MOD_RES (2)..(2): Xaa is Aib
  MOD_RES (20)..(20): Xaa is Aib
  MOD_RES (40)..(40): Xaa is d-Lysine
  MISC_FEATURE (40)..(40): 14 Carbon fatty acyl group covalently attached to d-Lysine
  MISC_FEATURE (40)..(40): C-terminal amidation
YXEGTFTSDYSIYLDKQAAXEFVCWLLAGGPSSGAPPPSX

SEQ ID NO: 1155 - protein, 40 aa, Artificial Sequence; identical to SEQ ID NO: 1154
  Synthetic polypeptide
  MOD_RES (2)..(2): Xaa is Aib
  MOD_RES (20)..(20): Xaa is Aib
  MOD_RES (40)..(40): Xaa is d-Lysine
  MISC_FEATURE (40)..(40): C-terminal amidation

SEQ ID NO: 1156 - protein, 40 aa, Artificial Sequence; identical to SEQ ID NO: 1154
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MOD_RES (40)..(40): Xaa is d-Lysine
  MISC_FEATURE (40)..(40): 14 Carbon fatty acyl group covalently attached to Lysine
  MISC_FEATURE (40)..(40): C-terminal amidation

SEQ ID NO: 1157 - protein, 40 aa, Artificial Sequence; identical to SEQ ID NO: 1154
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): Xaa is d-Lysine
  MISC_FEATURE (40)..(40): C-terminal amidation

SEQ ID NO: 1158 - protein, 39 aa, Artificial Sequence
  Synthetic polypeptide
  MOD_RES (2)..(2): Xaa is Aib
  MISC_FEATURE (10)..(10): 14 Carbon fatty acyl group covalently attached to Lysine
  MOD_RES (20)..(20): Xaa is Aib
  MISC_FEATURE (40)..(40): C-terminal amidation
YXEGTFTSDKSIYLDKQAAXEFVCWLLAGGPSSGAPPPS

SEQ ID NO: 1159 - protein, 39 aa, Artificial Sequence; identical to SEQ ID NO: 1158
  Synthetic polypeptide
  MOD_RES (2)..(2): Xaa is Aib
  MOD_RES (20)..(20): Xaa is Aib
  MISC_FEATURE (40)..(40): C-terminal amidation

SEQ ID NO: 1160 - protein, 41 aa, Artificial Sequence
  Synthetic polypeptide
  MOD_RES (2)..(2): Xaa is Aib
  MOD_RES (20)..(20): Xaa is Aib
  MISC_FEATURE (40)..(40): 14 Carbon fatty acyl group covalently attached to Lysine
  MISC_FEATURE (41)..(41): C-terminal amidation
YXEGTFTSDYSIYLDKQAAXEFVNWLLAGGPSSGAPPPSKC

SEQ ID NO: 1161 - protein, 41 aa, Artificial Sequence; identical to SEQ ID NO: 1160
  Synthetic polypeptide
  MOD_RES (2)..(2): Xaa is Aib
  MOD_RES (20)..(20): Xaa is Aib
  MISC_FEATURE (41)..(41): C-terminal amidation

SEQ ID NO: 1162 - protein, 39 aa, Artificial Sequence; identical to SEQ ID NO: 1158
  Synthetic polypeptide
  MOD_RES (2)..(2): Xaa is Aib
  MISC_FEATURE (10)..(10): 14 Carbon fatty acyl group covalently attached to Lysine
  MOD_RES (20)..(20): Xaa is Aib
  MISC_FEATURE (24)..(24): PEG (40kDa) covalently attached to Cysteine
  MISC_FEATURE (39)..(39): C-terminal amidation

SEQ ID NO: 1163 - protein, 41 aa, Artificial Sequence; identical to SEQ ID NO: 1160
  Synthetic polypeptide
  MOD_RES (2)..(2): Xaa is Aib
  MOD_RES (20)..(20): Xaa is Aib
  MISC_FEATURE (40)..(40): 14 Carbon fatty acyl group covalently attached to Lysine
  MISC_FEATURE (41)..(41): PEG (40kDa) covalently attached to Cysteine
  MISC_FEATURE (41)..(41): C-terminal amidation

SEQ ID NO: 1164 - protein, 41 aa, Artificial Sequence; identical to SEQ ID NO: 1160
  Synthetic polypeptide
  MOD_RES (2)..(2): Xaa is Aib
  MOD_RES (20)..(20): Xaa is Aib
  MISC_FEATURE (41)..(41): PEG (40kDa) covalently attached to Cysteine
  MISC_FEATURE (41)..(41): C-terminal amidation

SEQ ID NO: 1165 - protein, 40 aa, Artificial Sequence
  Synthetic polypeptide
  MOD_RES (2)..(2): Xaa is Aib
  MISC_FEATURE (40)..(40): 14 Carbon fatty acyl group covalently attached to Lysine
  MISC_FEATURE (40)..(40): C-terminal amidation
HXQGTFTSDYSKYLDEQAAKEFICWLMNGGPSSGAPPPSK

SEQ ID NO: 1166 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 14 Carbon fatty acyl group covalently attached to Lysine
  MISC_FEATURE (40)..(40): C-terminal amidation

SEQ ID NO: 1167 - protein, 40 aa, Artificial Sequence
  Synthetic polypeptide
  MOD_RES (2)..(2): Xaa is Aib
  MOD_RES (16)..(16): Xaa is Aib
  MISC_FEATURE (40)..(40): C-terminal amidation
YXQGTFTSDYSIYLDXQAAKEFVNWLLAGGPSSGAPPPSC

SEQ ID NO: 1168 - protein, 40 aa, Artificial Sequence
  Synthetic polypeptide
  MOD_RES (2)..(2): Xaa is Aib
  MOD_RES (16)..(16): Xaa is Aib
  MISC_FEATURE (40)..(40): C-terminal amidation
YXQGTFTSDYSIYLDXQAAQEFVNWLLAGGPSSGAPPPSC

SEQ ID NO: 1169 - protein, 40 aa, Artificial Sequence
  Synthetic polypeptide
  MOD_RES (2)..(2): Xaa is Aib
  MOD_RES (12)..(16): Lactam bridge between residues 12 and 16
  MOD_RES (20)..(20): Xaa is Aib
  MOD_RES (40)..(40): C-terminal amidation
YXQGTFTSDYSKYLDEQAAXEFVNWLLAGGPSSGAPPPSC

SEQ ID NO: 1170 - protein, 10 aa, Artificial Sequence
  Synthetic polypeptide
GPSSGAPPPK

SEQ ID NO: 1171 - protein, 11 aa, Artificial Sequence
  Synthetic polypeptide
  MOD_RES (1)..(1): Xaa is Gly or a small, aliphatic or non-polar or slightly polar amino acid
XGPSSGAPPPK

SEQ ID NO: 1172 - protein, 12 aa, Artificial Sequence
  Synthetic  polypeptide
  MOD_RES (1)..(1): Xaa is Gly or a small, aliphatic or non-polar or slightly polar amino acid
XGPSSGAPPPSK

SEQ ID NO: 1173 - protein, 40 aa, Artificial Sequence; identical to SEQ ID NO: 1167
  Synethic polypeptide
  MOD_RES (2)..(2): Xaa is Aib
  MOD_RES (16)..(16): Xaa is Aib
  MISC_FEATURE (40)..(40): PEG (40kDa) covalently attached to Cysteine
  MISC_FEATURE (40)..(40): C-terminal amidation

SEQ ID NO: 1174 - protein, 40 aa, Artificial Sequence; identical to SEQ ID NO: 1168
  Synthetic polypeptide
  MOD_RES (2)..(2): Xaa is Aib
  MOD_RES (16)..(16): Xaa is Aib
  MISC_FEATURE (40)..(40): PEG (40kDa) covalently attached to Cysteine
  MISC_FEATURE (40)..(40): C-terminal amidation

SEQ ID NO: 1175 - protein, 40 aa, Artificial Sequence; identical to SEQ ID NO: 1121
  Synthetic polypeptide
  MOD_RES (2)..(2): Xaa is Aib
  MOD_RES (16)..(16): Xaa is Aib
  MOD_RES (20)..(20): Xaa is Aib
  MISC_FEATURE (40)..(40): C-terminal amidation

SEQ ID NO: 1176 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): C-terminal amidation
YXQGTFTSDYSIYLDEQAAXEFVNWLLAGGPSSGAPPPSC

SEQ ID NO: 1177 - protein, 29 aa, Artificial Sequence
  Synthetic polypeptide
  MOD_RES (2)..(2): Xaa is Aib
  MOD_RES (20)..(20): Xaa is Aib
  MISC_FEATURE (29)..(29): C-terminal amidation
YXQGTFTSDYSIYLDEQAAXEFVCWLLAG

SEQ ID NO: 1178 - protein, 29 aa, Artificial Sequence
  Synthetic polypeptide
  MISC_FEATURE: C-terminal amidation
  MOD_RES (2)..(2): Xaa is Aib
  MOD_RES (20)..(20): Xaa is Aib
YXQGTFTSDYSIYLDSQAAXEFVCWLLAG

SEQ ID NO: 1179 - protein, 30 aa, Artificial Sequene
  Synthetic polypeptide
  MOD_RES (2)..(2): Xaa is Aib
  MISC_FEATURE (24)..(24): PEG (40kDa) covalently attached to Cysteine
HXEGTFTSDVSSYLEEQAAKEFICWLVKGR

SEQ ID NO: 1180 - protein, 42 aa, Artificial Sequence
  Synthetic polypeptide
  MISC_FEATURE (24)..(24): Substituted amino acid covalently linked to hydrophilic group
YAPGTFISDYSIAMDKIHQQDFVXWLLAQKGKKNWLKHNITQ

SEQ ID NO: 1181 - protein, 40 aa, Artificial Sequence
  Synthetic polypeptide
  MOD_RES (2)..(2): Xaa is Aib
  MISC_FEATURE (16)..(20): Lactam bridge between residues 16 and 20
  MISC_FEATURE (40)..(40): Substituted amino acid covalentaly linked to hydrophilic group
YXQGTFTSDYSIYLDEQAAKEFVNWLLAGGPSSGAPPPSX

SEQ ID NO: 1182 - protein, 29 aa, Artificial Sequence
  Synthetic polypeptide
  MOD_RES (2)..(2): Xaa is Aib
  MISC_FEATURE (16)..(20): Lactam bridge between residues 16 and 20
  MISC_FEATURE (24)..(24): Substituted amino acid covalently linked to hydrophilic group
  misc_feature (29)..(29): Xaa can be any naturally occurring amino acid
YXQGTFTSDYSIYLDEQAAKEFVXWLLAX

SEQ ID NO: 1183 - protein, 39 aa, Artificial Sequence
  Synthetic polypeptide
  MOD_RES (2)..(2): Xaa is Aib
  MISC_FEATURE (16)..(20): Lactam bridge between residues 16 and 20
  MISC_FEATURE (24)..(24): Substituted amino acid covalently linked to hydrophilic group
YXQGTFTSDYSIYLDEQAAKEFVXWLLAGGPSSGAPPPS

SEQ ID NO: 1184 - protein, 40 aa, Artificial Sequence
  Synthetic polypeptide
  MOD_RES (2)..(2): Xaa is Aib
  MISC_FEATURE (16)..(20): Lactam bridge between residues 16 and 20
  MISC_FEATURE (40)..(40): Substituted amino acid covalently linked to hydrophilic group
YXEGTFTSDYSIYLDEQAAKEFVNWLLAGGPSSGAPPPSX

SEQ ID NO: 1185 - protein, 29 aa, Artificial Sequence
  Sythetic polypeptide
  MOD_RES (2)..(2): Xaa is Aib
  MISC_FEATURE (16)..(20): Lactam bridge between residues 16 and 20
  MISC_FEATURE (24)..(24): Substituted amino acid covalently linked to hydrophilic group
YXQGTFISDYSIYLDEQAAKEFVXWLLAG

SEQ ID NO: 1186 - protein, 40 aa, Artificial Sequence
  Synthetic polypeptide
  MOD_RES (2)..(2): Xaa is Aib
  MISC_FEATURE (16)..(20): Lactam bridge between residues 16 and 20
  MISC_FEATURE (40)..(40): Substituted amino acid covalently linked to hydrophilic group
YXQGTFISDYSIYLDEQAAKEFVNWLLAGGPSSGAPPPSX

SEQ ID NO: 1187 - protein, 29 aa, Artificial sequence
  Synthetic polypeptide
  MOD_RES (2)..(2): Xaa is Aib
  MISC_FEATURE (16)..(20): Lactam bridge between residues 16 and 20
  MISC_FEATURE (24)..(24): Substituted amino acid covalently linked to hydrophilic group
YXQGTFTSDYSIYLDEQAAKEFVXWLMNG

SEQ ID NO: 1188 - protein, 40 aa, Artificial sequence
  Synthetic polypeptide
  MOD_RES (2)..(2): Xaa is Aib
  MISC_FEATURE (16)..(20): Lactam bridge between residues 16 and 20
  MISC_FEATURE (40)..(40): Substitute amino acid covalently linked to hydrophilic group
YXQGTFVSDYSIYLDEQAAKEFVNWLLAGGPSSGAPPPSX

SEQ ID NO: 1189 - protein, 40 aa, Artificial sequence
  Synthetic polypeptide
  MOD_RES (2)..(2): Xaa is Aib
  MISC_FEATURE (16)..(20): Lactam bridge between residues 16 and 20
  MOD_RES (27)..(27): Xaa is Nle
  MISC_FEATURE (40)..(40): Substituted amino acid covalently linked to hydrophilic group
YXQGTFTSDYSIYLDEQAAKEFVNWLXAGGPSSGAPPPSX

SEQ ID NO: 1190 - protein, 40 aa, Artificial sequence
  Synthetic polypeptide
  MOD_RES (2)..(2): Xaa is Aib
  MISC_FEATURE (16)..(20): Lactam bridge between residues 16 and 20
  MISC_FEATURE (40)..(40): Substituted amino acid covalently linked to hydrophilic group
YXEGTFTSDYSIYLDEQAAKEFVNWLLAGRPSSGAPPPSX

SEQ ID NO: 1191 - protein, 43 aa, Artificial sequence
  Synthetic polypeptide
  MOD_RES (2)..(2): Xaa is Aib
  MISC_FEATURE (16)..(20): Lactam bridge between residues 16 and 20
  MISC_FEATURE (43)..(43): Substituted amino acid covalently linked to hydrophilic group
YXEGTFTSDYSIYLDEQAAKEFVNWLLAGKGKKNWLKHNITQX

SEQ ID NO: 1192 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to hydrophilic group
  MISC_FEATURE (40)..(40): C-terminal amidation
YXEGTFTSDYSIYLDKQAAXEFVNWLLAGGPSSGAPPPSX

SEQ ID NO: 1193 - protein, 40 aa, Artificial Sequence
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): C-terminal amidation
YXEGTFTSDYSIYLDKQAAXEFVXWLLAGGPSSGAPPPSK

SEQ ID NO: 1194 - protein, 40 aa, Artificial Sequence
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): Substitute amino acid covalently linked to an acyl or alkyl group
  MISC_FEATURE (40)..(40): C-terminal amidation
YXEGTFTSDYSIYLDKQAAXEFVXWLLAGGPSSGAPPPSX

SEQ ID NO: 1195 - protein, 40 aa, Artificial Sequence; identical to SEQ ID NO: 1192
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to an acyl or alkyl group
  MISC_FEATURE (40)..(40): C-terminal amidation

SEQ ID NO: 1196 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to hydrophilic group
  MISC_FEATURE (40)..(40): C-terminal amidation
YXQGTFTSDYSIYLDKQAAXEFVNWLLAGGPSSGAPPPSX

SEQ ID NO: 1197 - protein, 39 aa, Artificial Sequence
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to acyl or alkyl group
  MISC_FEATURE (39)..(39): C-terminal amidation
YXEGTFTSDYSIYLDKQAAXEFVXWLLAGGPSSGAPPPS

SEQ ID NO: 1198 - protein, 39 aa, Artificial Sequence
  Synthetic polypeptide
  MOD_RES (2)..(2): Xaa is Aib
  MISC_FEATURE (10)..(10): Substituted amino acid covalently linked to acyl or alkyl group
  MOD_RES (20)..(20): Xaa is Aib
  MISC_FEATURE (39)..(39): C-terminal amidation
YXEGTFTSDXSIYLDKQAAXEFVNWLLAGGPSSGAPPPS

SEQ ID NO: 1199 - protein, 40 aa, Artificial Sequence; identical to SEQ ID NO: 1196
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 1200 - protein, 29 aa, Artificial Sequence
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (29)..(29): C-terminal amidation
YXQGTFTSDYSIYLDKQAAXEFVXWLLAG

SEQ ID NO: 1201 - protein, 29 aa, Artificial Sequence
  Synthetic polypeptide
  MOD_RES (2)..(2): Xaa is Aib
  MISC_FEATURE (10)..(10): Substituted amino acid covalently linked to acyl or alkyl group
  MOD_RES (20)..(20): Xaa is Aib
  MISC_FEATURE (29)..(29): C-terminal amidation
YXEGTFTSDXSIYLDKQAAXEFVNWLLAG

SEQ ID NO: 1202 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): Substituted amino acid covalently linked acyl or alkyl group
  MISC_FEATURE (40)..(40): C-terminal amidation
YXQGTFTSDYSIYLDKQAAXEFVCWLLAGGPSSGAPPPSX

SEQ ID NO: 1203 - protein, 40 aa, Artificial Sequence
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): Substituted amino acid covalently linked to acyl or alkyl group
  MISC_FEATURE (40)..(40): C-terminal amidation
YXQGTFTSDYSIYLDKQAAXEFVXWLLAGGPSSGAPPPSX

SEQ ID NO: 1204 - protein, 40 aa, Artificial Sequence
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): C-terminal amidation
YXQGTFTSDYSIYLDKQAAXEFVXWLLAGGPSSGAPPPSK

SEQ ID NO: 1205 - protein, 40 aa, Artificial Sequence; identical to SEQ ID NO: 1192
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to hydrophilic group
  MISC_FEATURE (40)..(40): C-terminal amidation

SEQ ID NO: 1206 - protein, 40 aa, Artificial Sequence; identical to SEQ ID NO: 1154
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 1207 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation
YXQGTFTSDYSIYLDKQAAXEFVCWLMNGGPSSGAPPPSX

SEQ ID NO: 1208 - protein, 40 aa, Artificial Sequence
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): Substituted amino acid covalently linked to acyl or alkyl group
  MISC_FEATURE (40)..(40): C-terminal amidation
YXQGTFTSDYSIYLDKQAAXEFVXWLMNGGPSSGAPPPSX

SEQ ID NO: 1209 - protein, 40 aa, Artificial Sequence; identical to SEQ ID NO: 1154
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 1210 - protein, 40 aa, Artificial Sequence; identical to SEQ ID NO: 1196
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 1211 - protein, 40 aa, Artificial Sequence; identical to SEQ ID NO: 1202
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 1212 - protein, 40 aa, Artificial Sequence; identical to SEQ ID NO: 1154
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 1213 - protein, 40 aa, Artificial Sequence; identical to SEQ ID NO: 1193
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): C-terminal amidation

SEQ ID NO: 1214 - protein, 40 aa, Artificial Sequence; identical to SEQ ID NO: 1154
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 1215 - protein, 40 aa, Artificial Sequence; identical to SEQ ID NO: 1194
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): Substituted amino acid covalently linked to acyl or alkyl group
  MISC_FEATURE (40)..(40): C-terminal amidation

SEQ ID NO: 1216 - protein, 40 aa, Artificial Sequence; identical to SEQ ID NO: 1194
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): C-terminal amidation

SEQ ID NO: 1217 - protein, 39 aa, Artificial Sequence
  Synthetic polypeptide
  MOD_RES (2)..(2): Xaa is Aib
  MISC_FEATURE (10)..(10): Substituted amino acid covalently linked to acyl or alkyl group
  MOD_RES (20)..(20): Xaa is Aib
  MISC_FEATURE (40)..(40): C-terminal amidation
YXEGTFTSDXSIYLDKQAAXEFVCWLLAGGPSSGAPPPS

SEQ ID NO: 1218 - protein, 41 aa, Artificial Sequence
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (41)..(41): C-terminal amidation
YXEGTFTSDYSIYLDKQAAXEFVNWLLAGGPSSGAPPPSXC

SEQ ID NO: 1219 - protein, 39 aa, Artificial Sequence
  Synthetic polypeptide
  MOD_RES (2)..(2): Xaa is Aib
  MISC_FEATURE (10)..(10): Substituted amino acid covalently linked to acyl or alkyl group
  MOD_RES (20)..(20): Xaa is Aib
  MISC_FEATURE (24)..(24): Substituted amino acid covalently linked to hydrophilic group
  MISC_FEATURE (39)..(39): C-terminal amidation
YXEGTFTSDXSIYLDKQAAXEFVXWLLAGGPSSGAPPPS

SEQ ID NO: 1220 - protein, 41 aa, Artificial Sequence
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (41)..(41): Substituted amino acid covalently linked to hydrophilic group
  MISC_FEATURE (41)..(41): C-terminal amidation
YXEGTFTSDYSIYLDKQAAXEFVNWLLAGGPSSGAPPPSXX

SEQ ID NO: 1221 - protein, 41 aa, Artificial Sequence
  Synthetic polypeptide
  MOD_RES (2)..(2): Xaa is Aib
  MOD_RES (20)..(20): Xaa is Aib
  MISC_FEATURE (41)..(41): Substituted amino acid covalently linked to hydrophilic group
  MISC_FEATURE (41)..(41): C-terminal amidation
YXEGTFTSDYSIYLDKQAAXEFVNWLLAGGPSSGAPPPSKX

SEQ ID NO: 1222 - protein, 40 aa, Artificial Sequence
  Synthetic polypeptide
  MOD_RES (2)..(2): Xaa is Aib
  MISC_FEATURE (40)..(40): Substituted amino acid covalently linked to acyl or alkyl group
  MISC_FEATURE (40)..(40): C-terminal amidation
HXQGTFTSDYSKYLDEQAAKEFICWLMNGGPSSGAPPPSX

SEQ ID NO: 1223 - protein, 40 aa, Artificial Sequence; identical to SEQ ID NO: 1194
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): Substituted amino acid covalently linked to acyl or alkyl group
  MISC_FEATURE (40)..(40): C-terminal amidation

SEQ ID NO: 1224 - protein, 40 aa, Artificial Sequence
  Synethic polypeptide
  MOD_RES (2)..(2): Xaa is Aib
  MOD_RES (16)..(16): Xaa is Aib
  MISC_FEATURE (40)..(40): Substituted amino acid covalently linked to hydrophilic group
  MISC_FEATURE (40)..(40): C-terminal amidation
YXQGTFTSDYSIYLDXQAAKEFVNWLLAGGPSSGAPPPSX

SEQ ID NO: 1225 - protein, 40 aa, Artificial Sequence
  Synthetic polypeptide
  MOD_RES (2)..(2): Xaa is Aib
  MOD_RES (16)..(16): Xaa is Aib
  MISC_FEATURE (40)..(40): Substituted amino acid covalently linked to hydrophilic group
  MISC_FEATURE (40)..(40): C-terminal amidation
YXQGTFTSDYSIYLDXQAAQEFVNWLLAGGPSSGAPPPSX

SEQ ID NO: 1226 - protein, 30 aa, Artificial Sequene; identical to SEQ ID NO: 1179
  Synthetic polypeptide
  MOD_RES (2)..(2): Xaa is Aib
  MISC_FEATURE (24)..(24): Substituted amino acid covalently linked to hydrophilic group

SEQ ID NO: 1227 - protein, 29 aa, Artificial Sequence
  Synthetic polypeptide
  MOD_RES (2)..(2): Xaa is Aib
  MOD_RES (20)..(20): Xaa is Aib
  MISC_FEATURE (29)..(29): C-terminal amidation
YXQGTFTSDYSIYLDKQAAXEFVNWLLAG

SEQ ID NO: 1228 - protein, 29 aa, Artificial Sequence
  Synthetic polypeptide
  MOD_RES (2)..(2): Xaa is D-Ser, D-Ala, Val, Gly, N-Methyl Ser, N-Methyl Ala, or Aib
  MOD_RES (16)..(16): Xaa is Lys, Glu, Ser, Orn, Dab, Aib or any alpha, alpha-disubstituted amino acid
  MOD_RES (20)..(20): Xaa is any alpha, alpha-disubstituted amino acid
  MOD_RES (27)..(27): Xaa is Ile, Leu, or Nle
  MOD_RES (28)..(28): Xaa is Ala or Gly
  MOD_RES (29)..(29): Xaa is Thr, Ala, or Gly
  MISC_FEATURE (29)..(29): C-terminal amidation
YXQGTFTSDYSIYLDXQAAXEFVNWLXXX

SEQ ID NO: 1229 - protein, 29 aa, Artificial Sequence
  Synthetic polypeptide
  MOD_RES (2)..(2): Xaa is Aib
  MOD_RES (20)..(20): Xaa is Aib
  MISC_FEATURE (29)..(29): C-terminal amidation
YXQGTFTSDYSKYLDKRRAXDFVQWLLAG

SEQ ID NO: 1230 - protein, 29 aa, Artificial Sequence
  Synthetic polypeptide
  MOD_RES (2)..(2): Xaa is D-Ser, DAla, Val, Gly, N-Methyl Ser, N-Methyl Ala, or Aib
  MOD_RES (16)..(16): Xaa is Lys, Glu, Ser, Orn, Dab, Aib or any alpha, alpha-disubstituted amino acid
  MOD_RES (20)..(20): Xaa is any alpha, alpha-disubstituted amino acid
  MOD_RES (27)..(27): Xaa is Ile, Leu, or Nle
  MOD_RES (28)..(28): Xaa is Ala or Gly
  MOD_RES (29)..(29): Xaa is Thr, Ala, or Gly
  MOD_RES (29)..(29): C-terminal amidation
YXQGTFTSDYSKYLDXRRAXDFVQWLXXX

SEQ ID NO: 1231 - protein, 41 aa, Artificial Sequence; identical to SEQ ID NO: 1160
  Synthetic polypeptide
  MISC_FEATURE: Homodimer
  MOD_RES (2)..(2): Xaa is Aib
  MOD_RES (20)..(20): Xaa is Aib
  MISC_FEATURE (40)..(40): 14 Carbon fatty acyl group covalently bound to Lysine
  MOD_RES (40)..(40): C-terminal amidation
  DISULFID (41)..(41): Disulfide bond formed with Cys residue of a second peptide having the same structure.

SEQ ID NO: 1232 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): C-terminal amidation
YXQGTFTSDYSIYLDKQAAXEFVNWLMNGGPSSGAPPPSK

SEQ ID NO: 1233 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): C-terminal amidation
YXQGTFISDYSIYLDKQAAXEFVNWLLAGGPSSGAPPPSK

SEQ ID NO: 1234 - protein, 40 aa, Artificial Sequence; identical to SEQ ID NO: 1233
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently bound to Lysine
  MISC_FEATURE (40)..(40): C-terminal amidation

SEQ ID NO: 1235 - protein, 40 aa, Artificial Sequence; identical to SEQ ID NO: 756
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently bound to Lysine via a dipeptide spacer
  MISC_FEATURE (40)..(40): C-terminal amidation

SEQ ID NO: 1236 - protein, 40 aa, Artificial Sequence; identical to SEQ ID NO: 1123
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently bound to Lysine via a dipeptide spacer
  MISC_FEATURE (40)..(40): C-terminal amidation

SEQ ID NO: 1237 - protein, 40 aa, Artificial Sequence; identical to SEQ ID NO: 765
  Synthetic polypeptide
  MOD_RES (2)..(2): Xaa is Aib
  MISC_FEATURE (10)..(10): 16 Carbon fatty acyl group covalently bound to Lysine via dipeptide spacer
  MOD_RES (20)..(20): Xaa is Aib
  MISC_FEATURE (40)..(40): C-terminal amidation

SEQ ID NO: 1238 - protein, 41 aa, Artificial Sequence; identical to SEQ ID NO: 1160
  Synthetic polypeptide
  MISC_FEATURE: Homodimer
  MOD_RES (2)..(2): Xaa is Aib
  MOD_RES (20)..(20): Xaa is Aib
  MISC_FEATURE (40)..(40): 14 Carbon fatty acyl group covelently bound to Lysine
  MISC_FEATURE (41)..(41): C-terminal amidation
  MISC_FEATURE (41)..(41): Cys residue covalently attached to 20 kDa PEG which is in turn covalently attached to a Cys residue of a second peptide having the same structure

SEQ ID NO: 1239 - protein, 41 aa, Artificial Sequence; identical to SEQ ID NO: 1160
  Synthetic polypeptide
  MISC_FEATURE: homodimer
  MOD_RES (2)..(2): Xaa is Aib
  MOD_RES (20)..(20): Xaa is Aib
  MISC_FEATURE (40)..(40): 14 Carbon fatty acyl group covalently bound to Lysine
  MISC_FEATURE (41)..(41): PEG (5kDa) covalently bound to Cysteine
  MISC_FEATURE (41)..(41): C-terminal amidation
  MISC_FEATURE (41)..(41): Cys residue covalently attached to 5 kDa PEG which is in turn covalently attached to a Cys residue of a second peptide having the same structure

SEQ ID NO: 1240 - protein, 29 aa, Artificial Sequence
  Synthetic polypeptide
  MOD_RES (3)..(3): Xaa is a Glutamine analog
  MOD_RES (27)..(27): Xaa is Nle
HSXGTFTSDYSKYLDTRRAAEFVAWLXDE

SEQ ID NO: 1241 - protein, 29 aa, Artificial Sequence
  Synthetic polypeptide
  MOD_RES (3)..(3): Xaa is a Glutamine analog
  MOD_RES (16)..(16): Xaa is Aib
HSXGTFTSDYSKYLDXRRAADFVAWLMDE

SEQ ID NO: 1242 - protein, 29 aa, Artificial Sequence
  Synthetic polypeptide
  MOD_RES (27)..(27): Xaa is Nle
HSQGTFTSDYSKYLDTRRAAEFVAWLXDE

SEQ ID NO: 1243 - protein, 29 aa, Artificial Sequence
  Synthetic peptide
  MOD_RES (3)..(3): Xaa is Acetamidomethyl-cysteine
  MOD_RES (27)..(27): Xaa is Nle
HSXGTFTSDYSKYLDTRRAAEFVAWLXDE

SEQ ID NO: 1244 - protein, 29 aa, Artificial Sequence
  Synthetic peptide
  MOD_RES (3)..(3): Xaa is Acetyldiaminobutanoic acid
  MOD_RES (27)..(27): Xaa is Nle
HSXGTFTSDYSKYLDTRRAAEFVAWLXDE

SEQ ID NO: 1245 - protein, 29 aa, Artificial Sequence
  Synthetic polypeptide
  MOD_RES (3)..(3): Xaa is carbamoyldiaminopropanoic acid
  MOD_RES (27)..(27): Xaa is Nle
HSXGTFTSDYSKYLDTRRAAEFVAWLXDE

SEQ ID NO: 1246 - protein, 29 aa, Artificial Sequence
  Synthetic polypeptide
  MOD_RES (3)..(3): Xaa is Methylglutamine
  MOD_RES (27)..(27): Xaa is Nle
HSXGTFTSDYSKYLDTRRAAEFVAWLXDE

SEQ ID NO: 1247 - protein, 29 aa, Artificial Sequence
  Synthetic peptide
  MOD_RES (3)..(3): Xaa is Methionine sulfoxide
  MOD_RES (27)..(27): Xaa is Nle
HSXGTFTSDYSKYLDTRRAAEFVAWLXDE

SEQ ID NO: 1248 - protein, 29 aa, Artificial Sequence
  Synthetic peptide
  MOD_RES (3)..(3): Xaa is Acetylornithine
  MOD_RES (27)..(27): Xaa is Nle
HSXGTFTSDYSKYLDTRRAAEFVAWLXDE

SEQ ID NO: 1249 - protein, 29 aa, Artificial Sequence
  Synthetic polypeptide
  MOD_RES (16)..(16): Xaa is Aib
HSQGTFTSDYSKYLDXRRAADFVAWLMDE

SEQ ID NO: 1250 - protein, 29 aa, Artificial Sequence
  Synthetic polypeptide
  MOD_RES (3)..(3): Xaa is Acetyldiaminobutanoic acid
  MOD_RES (16)..(16): Xaa is Aib
HSXGTFTSDYSKYLDXRRAADFVAWLMDE

SEQ ID NO: 1251 - protein, 29 aa, Artificial Sequence
  Synthetic polypeptide
  MOD_RES (3)..(3): Xaa is Methylglutamine
  MOD_RES (16)..(16): Xaa is Aib
HSXGTFTSDYSKYLDXRRAADFVAWLMDE

SEQ ID NO: 1252 - protein, 29 aa, Artificial Sequence
  Synthetic polypeptide
HSQGTFTSDYSKYLDSRRAQDFVQWLMDT

SEQ ID NO: 1253 - protein, 29 aa, Artificial Sequence
  Synthetic polypeptide
  MOD_RES (3)..(3): Xaa is Acetyldiaminobutanoic acid
  MOD_RES (16)..(16): Xaa is Aib
HSXGTFTSDYSKYLDXRRAADFVAWLLDE

SEQ ID NO: 1254 - protein, 39 aa, Artificial Sequence; identical to SEQ ID NO: 604
  Synthetic polypeptide
  MOD_RES (3)..(3): Xaa is Acetyldiaminobutanoic acid
  MOD_RES (16)..(16): Xaa is Aib
  MISC_FEATURE (39)..(39): C-terminal amidation

SEQ ID NO: 1255 - protein, 29 aa, Artificial Sequence
  Synthetic polypeptide
  MOD_RES (3)..(3): Xaa is Acetyldiaminobutanoic acid
  MOD_RES (16)..(16): Xaa is Aib
HSXGTFTSDYSKYLDXRRASDFVSWLLDE

SEQ ID NO: 1256 - protein, 29 aa, Artificial Sequence
  Synthetic polypeptide
  MOD_RES (3)..(3): Xaa is Acetyldiaminobutanoic acid
  MOD_RES (16)..(16): Xaa is Aib
HSXGTFTSDYSKYLDXRRATDFVTWLLDE

SEQ ID NO: 1257-1258 - skipped (2 entries)

SEQ ID NO: 1259 - protein, 40 aa, Artificial Sequence
  Synthetic peptide
  MOD_RES (2)..(2): Xaa is Aib
  MISC_FEATURE (16)..(20): Lactam bridge links Glu16 and Lys20
  MOD_RES (40)..(40): Epsilon amine of Lys is attached to Ala-Ac-Cys(PEG), wherein the Ac-Cys(PEG) is a Cys residue comprising an alpha amino group capped with an acetyl group (CH3CO) and comprising a 40 kDa PEG covalently attached to its side chain
YXQGTFTSDYSIYLDEQAAKEFVNWLLAGGPSSGAPPPSK

SEQ ID NO: 1260 - protein, 40 aa, Artificial Sequence; identical to SEQ ID NO: 1259
  Synthetic peptide
  MOD_RES (2)..(2): Xaa is Aib
  MISC_FEATURE (16)..(20): Lactam bridge links Glu16 and Lys20
  MOD_RES (40)..(40): Epsilon amine of Lys is attached to Arg-Ac-Cys(PEG), wherein the Ac-Cys(PEG) is a Cys residue comprising an alpha amino group capped with an acetyl group (CH3CO) and comprising a 40 kDa PEG covalently attached to its side chain

SEQ ID NO: 1261 - protein, 40 aa, Artificial Sequence; identical to SEQ ID NO: 761
  Synthetic peptide
  MOD_RES (2)..(2): Xaa is Aib
  MISC_FEATURE (16)..(20): Lactam bridge links Glu16 and Lys20
  MOD_RES (40)..(40): Cys-PEG covalently linked via thioether linkage

SEQ ID NO: 1262 - protein, 40 aa, Artificial Sequence
  Synthetic peptide
  MOD_RES (2)..(2): Xaa is Aib
HXQGTFTSDYSKYLDERRAQDFVQWLMNTGPSSGAPPPSK

SEQ ID NO: 1263-1300 - skipped (38 entries)

SEQ ID NO: 1301 - protein, 29 aa, Homo sapiens
HSQGTFTSDYSKYLDSRRAQDFVQWLMNT

SEQ ID NO: 1302 - protein, 28 aa, Artificial Sequence
  Synthetic Polypeptide
  MISC_FEATURE: Glucagon analogue
  MISC_FEATURE (8)..(8): Xaa is aspartic acid, glutamic acid, cysteic acid or homocysteic acid
SQGTFTSXYSKYLDSRRAQDFVQWLMNT

SEQ ID NO: 1303 - protein, 27 aa, Artificial Sequence
  Synthetic Polypeptide
  MISC_FEATURE: Glucagon analogue
  MISC_FEATURE (7)..(7): Xaa is aspartic acid, glutamic acid, cysteic acid or homocysteic acid
QGTFTSXYSKYLDSRRAQDFVQWLMNT

SEQ ID NO: 1304 - protein, 26 aa, Artificial Sequence
  Synthetic Polypeptide
  MISC_FEATURE: Glucagon analogue
  MISC_FEATURE (6)..(6): Xaa is aspartic acid, glutamic acid, cysteic acid or homocysteic acid
GTFTSXYSKYLDSRRAQDFVQWLMNT

SEQ ID NO: 1305 - protein, 25 aa, Artificial Sequence
  Synthetic Polypeptide
  MISC_FEATURE: Glucagon analogue
  MISC_FEATURE (5)..(5): Xaa is aspartic acid, glutamic acid, cysteic acid or homocysteic acid
TFTSXYSKYLDSRRAQDFVQWLMNT

SEQ ID NO: 1306 - protein, 24 aa, Artificial Sequence
  Synthetic Polypeptide
  MISC_FEATURE: Glucagon analogue
  MISC_FEATURE (4)..(4): Xaa is glutamic acid, cysteic acid or homocysteic acid
  MISC_FEATURE (22)..(22): Xaa at position 22 is Met, Leu or Nle
FTSXYSKYLDSRRAQDFVQWLXNT

SEQ ID NO: 1307 - protein, 24 aa, Artificial Sequence
  Synthetic Polypeptide
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
FTSXYSKYLDSRRAQDFVQWLXNT

SEQ ID NO: 1308 - protein, 24 aa, Artificial Sequence
  Synthetic Polypeptide
  MOD_RES (1)..(1): N-terminal amino group replaced with hydroxy group
  MISC_FEATURE (22)..(22): Xaa is  Met, Leu or Nle
  MOD_RES (24)..(24): C-terminal alpha carboxylate replaced with amide
FTSDYSRYLDSRRAQDFVQWLXNT

SEQ ID NO: 1309 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (11)..(11): Xaa is Lys, Cys, Orn, homocysteine or acetyl phenyalanine
  MISC_FEATURE (22)..(22): Xaa is Met, Leu or Nle
FTSXYSXYLDXRRAQDFVQWLXNT

SEQ ID NO: 1310 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is is Lys or Arg
  MISC_FEATURE (16)..(16): Xaa is Lys, Cys, Orn, homocysteine or acetyl phenylalanine
  MISC_FEATURE (22)..(22): Xaa is Met, Leu or Nle
FTSXYSXYLDSRRAQXFVQWLXNT

SEQ ID NO: 1311 - protein, 24 aa, Artificial Sequence
  Synthetic Polypetide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (19)..(19): Xaa is Lys, Cys, Orn, homocysteine or acetyl phenylalanine
  MISC_FEATURE (22)..(22): Xaa is Met, Leu or Nle
FTSXYSXYLDSRRAQDFVXWLXNT

SEQ ID NO: 1312 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (11)..(11): Xaa is Lys, Cys, Orn, homocysteine or acetyl phenylalanine
  MISC_FEATURE (19)..(19): Xaa is Lys, Cys, Orn, homocysteine or acetyl phenylalanine
  MISC_FEATURE (22)..(22): Xaa is Met, Leu or Nle
FTSXYSXYLDXRRAQDFVXWLXNT

SEQ ID NO: 1313 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MOD_RES (11)..(11): Pegylated
  MISC_FEATURE (22)..(22): Xaa is Met, Leu or Nle
FTSXYSKYLDCRRAQDFVQWLXNT

SEQ ID NO: 1314 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MOD_RES (19)..(19): Pegylated
  MISC_FEATURE (22)..(22): Xaa is Met, Leu or Nle
FTSXYSKYLDSRRAQDFVCWLXNT

SEQ ID NO: 1315 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
  MOD_RES (24)..(24): Pegylated
FTSXYSKYLDSRRAQDFVQWLXNC

SEQ ID NO: 1316 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MOD_RES (19)..(19): Pegylated
  MISC_FEATURE (22)..(22): Xaa is Met, Leu or Nle
FTSXYSRYLDSRRAQDFVKWLXNT

SEQ ID NO: 1317 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MOD_RES (11)..(11): Pegylated
  MISC_FEATURE (22)..(22): Xaa is Met, Leu or Nle
FTSXYSKYLDCRRAQDFVCWLXNT

SEQ ID NO: 1318 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
  MOD_RES (24)..(24): C-terminal alpha carboxylate replaced with amide
FTSXYSKYLECRRAQDFVQWLXNT

SEQ ID NO: 1319 - protein, 10 aa, Artificial Sequence
  Synthetic Polypeptide
  MISC_FEATURE: Peptide fragment representing the carboxy terminal 10 amino acids of Exendin-4
GPSSGAPPPS

SEQ ID NO: 1320 - protein, 8 aa, Artificial Sequence
  Synthetic Polypeptide
  MISC_FEATURE: Peptide fragment representing the carboxy terminal 8 amino acids of oxyntomodulin
KRNRNNIA

SEQ ID NO: 1321 - protein, 4 aa, Artificial Sequence
  Synthetic Polypeptide
  MISC_FEATURE: Peptide fragment representing the carboxy 4 amino acids of oxyntomodulin carboxy terminus
KRNR

SEQ ID NO: 1322 - protein, 24 aa, Artificial Sequence
  Synthetic Polypeptide
  MISC_FEATURE: Glucagon analogue
  MISC_FEATURE (7)..(7): Xaa is Lys or Arg
  MISC_FEATURE (11)..(11): Xaa is Lys, Cys, Orn, homocycstein or acetyl phenyalanine
  MISC_FEATURE (19)..(19): Xaa is Lys, Cys, Orn, homocycstein or acetyl phenyalanine
FTSRYSXYLDXRRAQDFVXWLMNT

SEQ ID NO: 1323 - protein, 34 aa, Artificial Sequence
  Synthetic Polypeptide
  MISC_FEATURE: Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (16)..(16): Xaa is Lys, Cys, Orn, homocysteine or acetyl phenylalanine
  MISC_FEATURE (22)..(22): Xaa is Met, Leu or Nle
FTSXYSXYLDSRRAQXFVQWLXNTGPSSGAPPPS

SEQ ID NO: 1324 - protein, 32 aa, Artificial Sequence
  Synthetic Polypeptide
  MISC_FEATURE: Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (19)..(19): Xaa is Lys, Cys, Orn, homocysteine or acetyl phenylalanine
  MOD_RES (19)..(19): Pegylated
  MISC_FEATURE (22)..(22): Xaa is Met, Leu or Nle
FTSXYSXYLDSRRAQDFVXWLXNTKRNRNNIA

SEQ ID NO: 1325 - protein, 34 aa, Artificial Sequence
  Synthetic Polypeptide
  MISC_FEATURE: Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (19)..(19): Xaa is Lys, Cys, Orn, homocysteine or acetyl phenylalanine
  MOD_RES (19)..(19): Pegylated
  MISC_FEATURE (22)..(22): Xaa is Met, Leu or Nle
FTSXYSXYLDSRRAQDFVXWLXNTGPSSGAPPPS

SEQ ID NO: 1326 - protein, 32 aa, Artificial Sequence
  Synthetic Polypeptide
  MISC_FEATURE: Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (16)..(16): Xaa is Lys, Cys, Orn, homocysteine or acetyl phenylalanine
  MOD_RES (16)..(16): Pegylation
  MISC_FEATURE (22)..(22): Xaa is Met, Leu or Nle
FTSXYSXYLDSRRAQXFVQWLXNTKRNRNNIA

SEQ ID NO: 1327 - protein, 28 aa, Artificial Sequence
  Synthetic Polypeptide
  MISC_FEATURE: Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (16)..(16): Xaa is Lys, Cys, Orn, homocysteine or acetyl phenylalanine
  MOD_RES (16)..(16): Pegylated
  MISC_FEATURE (22)..(22): Xaa is Met, Leu or Nle
FTSXYSXYLDSRRAQXFVQWLXNTKRNR

SEQ ID NO: 1328 - protein, 28 aa, Artificial Sequence
  Synthetic Polypeptide
  MISC_FEATURE: Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (19)..(19): Xaa is Lys, Cys, Orn, homocysteine or acetyl phenylalanine
  MOD_RES (19)..(19): Pegylated
  MISC_FEATURE (22)..(22): Xaa is Met, Leu or Nle
FTSXYSXYLDSRRAQDFVXWLXNTKRNR

SEQ ID NO: 1329 - protein, 34 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
FTSXYSKYLDSRRAQDFVQWLXNTGPSSGAPPPS

SEQ ID NO: 1330 - protein, 32 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
FTSXYSKYLDSRRAQDFVQWLXNTKRNRNNIA

SEQ ID NO: 1331 - protein, 28 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
FTSXYSKYLDSRRAQCFVQWLXNTKRNR

SEQ ID NO: 1332 - protein, 29 aa, Artificial Sequence
  Synthetic Polypeptide
  MISC_FEATURE: Glucagon analogue
HSQGTFTSDYSKYLDSCRAQDFVQWLMNT

SEQ ID NO: 1333 - protein, 39 aa, Artificial Sequence; identical to SEQ ID NO: 521
  Synthetic Polypeptide
  MISC_FEATURE: Glucagon analogue

SEQ ID NO: 1334 - protein, 29 aa, Artificial Sequence
  Synthetic Polypeptide
  MISC_FEATURE: Glucagon analogue
  MOD_RES (24)..(24): 2-butyrolactone bound through thiol group of Cysteine
HSQGTFTSDYSKYLDSRRAQCFVQWLMNT

SEQ ID NO: 1335 - protein, 29 aa, Artificial Sequence
  Synthetic Polypeptide
  MISC_FEATURE: Glucagon Analogue
  MOD_RES (24)..(24): Carboxymethyl group bound through thiol group of Cysteine
HSQGTFTSDYSKYLDSRRAQCFVQWLMNT

SEQ ID NO: 1336 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
FTSXYSKYLESRRAQDFVQWLXNT

SEQ ID NO: 1337 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (22)..(22): Xaa is Met, Leu or Nle
FTSDYSKYLDSRRAQDFVQWLXNT

SEQ ID NO: 1338 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (22)..(22): Xaa is Met, Leu or Nle
FTSDYSKYLESRRAQDFVQWLXNT

SEQ ID NO: 1339 - protein, 24 aa, Artificial Sequence
  Synthetic Polypeptide
  MISC_FEATURE: Glucagon analogue
  MISC_FEATURE (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
  MISC_FEATURE (23)..(23): Xaa is Asn, Asp, Glu, cysteic acid or homocysteic acid
  MISC_FEATURE (24)..(24): Xaa id Thr, Asp, Glu, cysteic acid or homocysteic acid
FTSXYSKYLDSRRAQDFVQWLXXX

SEQ ID NO: 1340 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Glu, cysteic acid, homoglutamic acid or homocysteic acid
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
FTSXYSKYLXSRRAQDFVQWLXXX

SEQ ID NO: 1341 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Glu, cysteic acid, homoglutamic acid or homocysteic acid
  MISC_FEATURE (22)..(22): Xaa is Met, Leu or Nle
  MISC_FEATURE (23)..(23): Xaa is Asn, Asp or Glu
  MISC_FEATURE (24)..(24): Xaa is Thr, glu or Asp
FTSXYSKYLXSRRAQDFVQWLXXX

SEQ ID NO: 1342 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Glu, cysteic acid, homoglutamic acid or homocysteic acid
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
FTSXYSKYLXSRRAQDFVQWLXXX

SEQ ID NO: 1343 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MOD_RES (11)..(11): 20kDa PEG group attached to Xaa at position 11
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
FTSXYSKYLXCRRAQDFVQWLXXX

SEQ ID NO: 1344 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MOD_RES (16)..(16): 20kDa PEG group attached to Xaa at position 16
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
FTSXYSKYLXSRRAQCFVQWLXXX

SEQ ID NO: 1345 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MOD_RES (19)..(19): Pegylated
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
FTSXYSKYLXSRRAQDFVCWLXXX

SEQ ID NO: 1346 - protein, 35 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
  MISC_FEATURE (25)..(25): Xaa is Lys, Cys, Orn, homocycstein or acetyl phenyalanine
  MOD_RES (25)..(25): Pegylated
FTSXYSKYLXSRRAQDFVQWLXXXXGPSSGAPPPS

SEQ ID NO: 1347 - protein, 35 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
  MISC_FEATURE (35)..(35): Xaa is Lys, Cys, Orn, homocysteine or acetyl phenyalanine
  MOD_RES (35)..(35): Pegylated
FTSXYSKYLXSRRAQDFVQWLXXXGPSSGAPPPSX

SEQ ID NO: 1348 - protein, 39 aa, Artificial Sequence
  Synthetic Polypeptide
  MISC_FEATURE: Glucagon analogue
HSQGTFTSDYSRYLDSRRAQDFVQWLMNTGPSSGAPPPS

SEQ ID NO: 1349 - protein, 35 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (22)..(22): Xaa is Met , Leu or Nle
  MISC_FEATURE (35)..(35): Xaa is Lys, Cys, Orn, homocysteine or acetyl phenyalanine
  MOD_RES (35)..(35): Pegylated
FTSXYSXYLDSRRAQDFVQWLXNTGPSSGAPPPSX

SEQ ID NO: 1350 - protein, 24 aa, Artificial Sequence
  Synthetic Polypeptide
  MISC_FEATURE: Glucagon analogue
  MOD_RES (1)..(1): N-terminal amino group replaced with hydroxy group
FTSEYSKYLDSRRAQDFVQWLMNT

SEQ ID NO: 1351 - protein, 20 aa, Artificial Sequence
  Synthetic Polypeptide
  MISC_FEATURE: Glucagon analogue
YSKYLDSRRAQDFVQWLMNT

SEQ ID NO: 1352 - protein, 24 aa, Artificial Sequence
  Synthetic Polypeptide
  MISC_FEATURE: Glucagon analogue
  MISC_FEATURE (4)..(4): Xaa is Homocysteic acid
FTSXYSKYLDSRRAQDFVQWLMNT

SEQ ID NO: 1353 - protein, 11 aa, Artificial Sequence
  Synthetic Polypeptide
  MISC_FEATURE: Peptide fragment representing the carboxy terminal 10 amino acids of Exendin-4
  MISC_FEATURE (11)..(11): Xaa is Lys, Cys, Orn, homocysteine or acetyl phenyalanine
GPSSGAPPPSX

SEQ ID NO: 1354 - protein, 6 aa, Artificial Sequence
  Synthetic Polypeptide
  MISC_FEATURE (6)..(6): Xaa is phenyl lactic acid
HSQGTX

SEQ ID NO: 1355 - protein, 5 aa, Artificial Sequence
  Synthetic Polypeptide
  MISC_FEATURE (5)..(5): Xaa is phenyl lactic acid
SQGTX

SEQ ID NO: 1356 - protein, 4 aa, Artificial Sequence
  Synthetic Polypeptide
  MISC_FEATURE (4)..(4): Xaa is phenyl lactic acid
QGTX

SEQ ID NO: 1357 - protein, 3 aa, Artificial Sequence
  Synthetic Polypeptide
  MISC_FEATURE (3)..(3): Xaa is phenyl lactic acid
GTX

SEQ ID NO: 1358 - protein, 2 aa, Artificial Sequence
  Synthetic Polypeptide
  MISC_FEATURE (2)..(2): Xaa is phenyl lactic acid
TX

SEQ ID NO: 1359 - protein, 6 aa, Artificial Sequence
  Synthetic Polypeptide
  MISC_FEATURE (1)..(1): Xaa is selected from a group consisting of His, D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and
  MISC_FEATURE (2)..(2): Xaa is selected from a group consisting of Ser, D-serine, D-alanine, Val, Gly, N-methyl serine, N-methyl alanine, and aminoisobutyric acid (AIB)
  MISC_FEATURE (3)..(3): Xaa is selected from a group consisting of Glu or Gln
  MISC_FEATURE (6)..(6): Xaa is phenyl lactic acid
XXXGTX

SEQ ID NO: 1360 - protein, 5 aa, Artificial Sequence
  Synthetic Polypeptide
  MISC_FEATURE (1)..(1): Xaa is selected from a group consisting of Ser, D-serine, D-alanine, Val, Gly, N-methyl serine, N-methyl alanine, and aminoisobutyric acid (AIB)
  MISC_FEATURE (2)..(2): Xaa is selected from a group consisting of Glu or Gln
  MISC_FEATURE (5)..(5): Xaa is phenyl lactic acid
XXGTX

SEQ ID NO: 1361 - protein, 4 aa, Artificial Sequence
  Synthetic Polypeptide
  MISC_FEATURE (1)..(1): Xaa is selected from a group consisting of Glu and Gln
  MISC_FEATURE (4)..(4): Xaa is phenyl lactic acid
XGTX

SEQ ID NO: 1362 - protein, 24 aa, Artificial Sequence
  Synthetic Polypeptide
  MOD_RES (1)..(1): N-terminal amino group replaced with hydroxy group
  MOD_RES (24)..(24): C-terminal alpha carboxylate optionally replaced with amide
FTSDYSKYLDSRRAQDFVQWLMDT

SEQ ID NO: 1363 - protein, 28 aa, Artificial Sequence
  Synthetic Polypeptide
  MOD_RES (28)..(28): C-terminal alpha carboxylate optionally replaced with amide
SQGTFTSEYSKYLDSRRAQDFVQWLMNT

SEQ ID NO: 1364 - protein, 28 aa, Artificial Sequence
  Synthetic Polypeptide
  MISC_FEATURE (4)..(5): Threonine in position 4 and phenyl lactic acid in position 5 linked via ester bond
  MISC_FEATURE (5)..(5): Xaa is phenyl lactic acid
  MOD_RES (28)..(28): Optional C-terminal alpha carboxylate replaced with amide
  MOD_RES (28)..(28): C-terminal alpha carboxylate optionally replaced with amide
SQGTXTSEYSKYLDSRRAQDFVQWLMNT

SEQ ID NO: 1365 - protein, 29 aa, Artificial Sequence
  Synthetic Polypeptide
  MISC_FEATURE (5)..(6): Threonine in position 5 and phenyl lactic acid in position 6 linked via ester bond
  MISC_FEATURE (6)..(6): Xaa is phenyl lactic acid
  MOD_RES (29)..(29): C-terminal alpha carboxylate optionally replaced with amide
HSQGTXTSEYSKYLDSRRAQDFVQWLMNT

SEQ ID NO: 1366 - protein, 24 aa, Artificial Sequence
  Synthetic Polypeptide
  MOD_RES (1)..(1): N-terminal amino group replaced with hydroxy group
  MISC_FEATURE (11)..(11): Xaa is amino isobutyric acid
FTSDYSKYLDXRRAQDFVQWLMNT

SEQ ID NO: 1367 - protein, 24 aa, Artificial Sequence
  Synthetic Polypeptide
  MOD_RES (1)..(1): N-terminal amino group replaced with hydroxy group
FTSDYSKYLDERRAQDFVQWLMNT

SEQ ID NO: 1368 - protein, 6 aa, Artificial Sequence
  Synthetic Polypeptide
  MISC_FEATURE (1)..(1): Xaa is selected from a group consisting of His, D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and
  MISC_FEATURE (2)..(2): Xaa is selected from a group consisting of Ser, D-serine, D-alanine, Val, Gly, N-methyl serine, N-methyl alanine, and aminoisobutyric acid (AIB)
  MISC_FEATURE (3)..(3): Xaa is selected from a group consisting of Glu or Gln
XXXTGF

SEQ ID NO: 1369 - protein, 5 aa, Artificial Sequence
  Synthetic Polypeptide
  MISC_FEATURE (1)..(1): Xaa is selected from a group consisting of Ser, D-serine, D-alanine, Val, Gly, N-methyl serine, N-methyl alanine, and aminoisobutyric acid (AIB)
  MISC_FEATURE (2)..(2): Xaa is selected from a group consisting of Glu or Gln
XXTGF

SEQ ID NO: 1370 - protein, 4 aa, Artificial Sequence
  Synthetic Polypeptide
  MISC_FEATURE (1)..(1): Xaa is selected from a group consisting of Glu or Gln
XTGF

SEQ ID NO: 1371 - protein, 24 aa, Artificial Sequence
  Synthetic Polypeptide
  MOD_RES (1)..(1): N-terminal amino group replaced with hydroxy group
  MISC_FEATURE (24)..(24): C-terminal alpha carboxylate optionally replaced with an amide
FTSEYSKYLDSRRAQDFVQWLMNT

SEQ ID NO: 1372-1400 - skipped (29 entries)

SEQ ID NO: 1401 - protein, 29 aa, Homo sapiens
HSQGTFTSDYSKYLDSRRAQDFVQWLMNT

SEQ ID NO: 1402 - protein, 24 aa, Artificial Sequence
  Synthetic Polypeptide
  MISC_FEATURE: Glucagon analogue
  MOD_RES (1)..(1): N-terminal amino group replaced with hydroxy group
FTSDYSKYLDSRRAQDFVQWLMNT

SEQ ID NO: 1403 - protein, 31 aa, Homo sapiens; identical to SEQ ID NO: 703

SEQ ID NO: 1404 - protein, 30 aa, Homo sapiens; identical to SEQ ID NO: 704

SEQ ID NO: 1405 - protein, 24 aa, Artificial Sequence
  Synthetic Polypeptide
  MISC_FEATURE: Glucagon analogue
  MOD_RES (1)..(1): N-terminal amino group replaced with hydroxy group
FTSDYSKYLDERRAQDFVQWLMNT

SEQ ID NO: 1406 - protein, 24 aa, Artificial Sequence
  Synthetic Polypeptide
  MOD_RES (1)..(1): N-terminal amino group replaced with hydroxy group
FTSDYSKYLDERRAKDFVQWLMNT

SEQ ID NO: 1407 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (11)..(11): Xaa is Ser or Glu
FTSDYSKYLDXRRAKDFVEWLMNT

SEQ ID NO: 1408 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (11)..(11): Xaa is Ser or Glu
FTSDYSKYLDXRRAQDFVEWLMKT

SEQ ID NO: 1409 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (7)..(7): Xaa at position 7 is Lys or Glu
  MISC_FEATURE (10)..(10): Xaa is Asp, Glu, homoglutamic acid, cysteic acid or homocysteic acid
  MISC_FEATURE (11)..(11): Xaa is Ala, Ser, Glu, Lys, homoglutamic acid or homocysteic acid
  MISC_FEATURE (15)..(15): Xaa is Gln, Glu or Lys
  MISC_FEATURE (19)..(19): Xaa is Ala, Gln, Lys or Glu
  MISC_FEATURE (23)..(23): Xaa is Asn, Lys or an acidic amino acid
  MISC_FEATURE (24)..(24): Xaa is Thr or an acidic amino acid
FTSDYSXYLXXRRAXDFVXWLMXX

SEQ ID NO: 1410 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (11)..(11): Xaa is Ala, Ser, Glu, Gln, homoglutamic acid or homocysteic acid
  MISC_FEATURE (15)..(15): Xaa is Gln or Lys
  MISC_FEATURE (19)..(19): Xaa is Ala, Gln or Glu
  MISC_FEATURE (23)..(23): Xaa is Asn, Lys or an acidic amino acid
FTSDYSKYLDXRRAXDFVXWLMXT

SEQ ID NO: 1411 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (11)..(11): Xaa is Ala, Ser, Glu, Gln, homoglutamic acid or homocysteic acid
  MISC_FEATURE (15)..(15): Xaa is Gln or Lys
FTSDYSKYLDXRRAXDFVQWLMNT

SEQ ID NO: 1412 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (15)..(15): Xaa is Lys or Gln
  MISC_FEATURE (16)..(16): Xaa is Lys, Cys, Orn, homocysteine or acetyl phenyalanine
  MOD_RES (16)..(16): Pegylated
  MISC_FEATURE (19)..(19): Xaa is Lys, Cys, Orn, homocysteine or acetyl phenylalanine
  MOD_RES (19)..(19): Pegylated
  MISC_FEATURE (22)..(22): Xaa is Met, Leu or Nle
FTSXYSXYLDERRAXXFVXWLXNT

SEQ ID NO: 1413 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (15)..(15): Xaa is Lys or Gln
  MISC_FEATURE (16)..(16): Xaa is Cys, Orn, homocysteine or acetyl phenyalanine
  MOD_RES (16)..(16): Pegylated
  MISC_FEATURE (22)..(22): Xaa is Met, Leu or Nle
FTSXYSKYLDERRAXXFVQWLXNT

SEQ ID NO: 1414 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (15)..(15): Xaa is Lys or Gln
  MISC_FEATURE (19)..(19): Xaa is Cys, Orn, homocysteine or acetyl phenylalanine
  MOD_RES (19)..(19): Pegylated
  MISC_FEATURE (22)..(22): Xaa is Met, Leu or Nle
FTSXYSKYLDERRAXDFVXWLXNT

SEQ ID NO: 1415 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid, homoglutamic acid or homocysteic acid
  MISC_FEATURE (7)..(7): Xaa is Lys or Glu
  MISC_FEATURE (10)..(10): Xaa is Asp, Glu, cysteic acid, homoglutamic acid or homocysteic acid
  MISC_FEATURE (11)..(11): Xaa is Ala, Ser, Glu, Lys Gln, homoglutamic acid or homocysteic acid
  MISC_FEATURE (15)..(15): Xaa is Arg, Gln, Glu or Lys
  MISC_FEATURE (19)..(19): Xaa is Ala, Gln, Lys or Glu
  MISC_FEATURE (22)..(22): Xaa is Met, Leu or Nle
  MISC_FEATURE (23)..(23): Xaa is Asn, Lys or an acidic amino acid
  MISC_FEATURE (24)..(24): Xaa is Thr or an acidic amino acid
FTSXYSXYLXXRRAXDFVXWLXXX

SEQ ID NO: 1416 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (7)..(11): Lactam bridge connecting residues 7 and 11
  MISC_FEATURE (10)..(10): Xaa is Glu or Asp
  MISC_FEATURE (22)..(22): Xaa is Met, Leu or Nle
  MISC_FEATURE (23)..(23): Xaa is Asn, Asp or Glu
  MOD_RES (24)..(24): C-terminal alpha carboxylate replaced with amide
FTSDYSKYLXERRAQDFVQWLXXT

SEQ ID NO: 1417 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (10)..(10): Xaa is Asp or Glu
  MISC_FEATURE (11)..(15): Lactam bridge connecting residues 11 and 15
  MISC_FEATURE (22)..(22): Xaa is Met, Leu or Nle
  MISC_FEATURE (23)..(23): Xaa is Asn, Asp or Glu
  MOD_RES (24)..(24): C-terminal alpha carboxylate replaced with amide
FTSDYSKYLXERRAKDFVQWLXXT

SEQ ID NO: 1418 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (10)..(10): Xaa is Asp or Glu
  MISC_FEATURE (11)..(11): Xaa is Ser or Glu
  MISC_FEATURE (15)..(19): Lactam bridge connecting residues 15 and 19
  MISC_FEATURE (22)..(22): Xaa is Met, Leu or Nle
  MISC_FEATURE (23)..(23): Xaa is Asn, Asp or Glu
  MOD_RES (24)..(24): C-terminal alpha carboxylate replaced with amide
FTSDYSKYLXXRRAKDFVEWLXXT

SEQ ID NO: 1419 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (10)..(10): Xaa is Asp or Glu
  MISC_FEATURE (11)..(11): Xaa is Ser or Glu
  MISC_FEATURE (19)..(23): Lactam bridge connecting residues 19 and 23
  MISC_FEATURE (22)..(22): Xaa is Met, Leu or Nle
  MISC_FEATURE (24)..(24): Xaa is Thr or Glu
  MOD_RES (24)..(24): C-terminal alpha carboxylate replaced with amide
FTSDYSKYLXXRRAQDFVEWLXKX

SEQ ID NO: 1420 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Glu
  MISC_FEATURE (10)..(10): Xaa is Asp, Glu, cysteic acid, homoglutamic acid or homocysteic acid
  MISC_FEATURE (11)..(11): Xaa is Ala, Ser, Glu, Lys Gln, homoglutamic acid or homocysteine
  MISC_FEATURE (15)..(15): Xaa is Arg, Gln, Glu or Lys
  MISC_FEATURE (19)..(19): Xaa is Ala, Gln, Lys or Glu
  MISC_FEATURE (22)..(22): Xaa is Met, Leu or Nle
  MISC_FEATURE (23)..(23): Xaa is Asn, Lys, Asp, Glu, cysteic acid or homocysteic acid
  MISC_FEATURE (24)..(24): Xaa is Thr, Asp, Glu, cysteic acid and homocysteic acid
FTSXYSXYLXXRRAXDFVXWLXXX

SEQ ID NO: 1421 - protein, 10 aa, Artificial Sequence
  Synthetic Polypeptide
  MISC_FEATURE: Peptide fragment representing the carboxy terminal 10 amino acids of Exendin-4
GPSSGAPPPS

SEQ ID NO: 1422 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(11): Lactam bridge connecting residues 7 and 11
  MISC_FEATURE (10)..(10): Xaa is Asp, Glu, cysteic acid, homoglutamic acid and homocysteic acid
  MISC_FEATURE (22)..(22): Xaa is Met, Leu or Nle
FTSXYSKYLXERRAQDFVQWLXNT

SEQ ID NO: 1423 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid and homocysteic acid
  MISC_FEATURE (11)..(15): Lactam bridge connecting residues 11 and 15
  MISC_FEATURE (22)..(22): Xaa is Met, Leu or Nle
FTSXYSKYLXERRAKDFVQWLXNT

SEQ ID NO: 1424 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid and homocysteic acid
  MISC_FEATURE (15)..(19): Lactam bridge connecting residues 15 and 19
  MISC_FEATURE (22)..(22): Xaa is Met, Leu or Nle
FTSXYSKYLXERRAKDFVEWLXNT

SEQ ID NO: 1425 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid and homocysteic acid
  MISC_FEATURE (19)..(24): Lactam bridge connecting residues 19 and 24
  MISC_FEATURE (22)..(22): Xaa is Met, Leu or Nle
FTSXYSKYLXERRAQDFVEWLXKT

SEQ ID NO: 1426 - protein, 8 aa, Artificial Sequence
  Synthetic Polypeptide
  MISC_FEATURE: Peptide fragment representing the carboxy terminal 8 amino acids of oxyntomodulin
KRNRNNIA

SEQ ID NO: 1427 - protein, 4 aa, Artificial Sequence
  Synthetic Polypeptide
  MISC_FEATURE: Peptide fragment representing the carboxy 4 amino acids of oxyntomodulin carboxy terminus
KRNR

SEQ ID NO: 1428 - protein, 34 aa, Artificial Sequence
  Synthetic Polypeptide
  MISC_FEATURE: Glucagon analogue
FTSEYSKYLDERRAQDFVQWLMNTGPSSGAPPPS

SEQ ID NO: 1429 - protein, 34 aa, Artificial Sequence; identical to SEQ ID NO: 1428
  Synthetic Polypeptide
  MISC_FEATURE (7)..(11): Lactam bridge connecting residues 7 and 11

SEQ ID NO: 1430 - protein, 34 aa, Artificial Sequence
  Synthetic Polypeptide
  MISC_FEATURE: Glucagon analogue
  MISC_FEATURE (11)..(15): Lactam bridge connecting residues 11 and 15
FTSEYSKYLDERRAKDFVQWLMNTGPSSGAPPPS

SEQ ID NO: 1431 - protein, 34 aa, Artificial Sequence
  Synthetic Polypeptide
  MISC_FEATURE: Glucagon analogue
  MISC_FEATURE (7)..(11): Lactam bridge connecting residues 7 and 11
FTSDYSKYLDERRAQDFVQWLMNTGPSSGAPPPS

SEQ ID NO: 1432 - protein, 34 aa, Artificial Sequence; identical to SEQ ID NO: 1428
  Synthetic Polypeptide
  MISC_FEATURE: Glucagon analogue
  MOD_RES (1)..(1): N-terminal amino group replaced with hydroxy group
  MISC_FEATURE (7)..(11): Lactam bridge connecting residues 7 and 11

SEQ ID NO: 1433 - protein, 34 aa, Artificial Sequence; identical to SEQ ID NO: 1430
  Synthetic Polypeptide
  MISC_FEATURE: Glucagon analogue
  MOD_RES (1)..(1): N-terminal amino group replaced with hydroxy group
  MISC_FEATURE (11)..(15): Lactam bridge connecting residues 11 and 15

SEQ ID NO: 1434 - protein, 24 aa, Artificial Sequence
  Synthetic Polypeptide
  MISC_FEATURE: Glucagon analogue
  MOD_RES (1)..(1): N-terminal amino group replaced with hydroxy group
FTSDYSKYLDSRRAQDFVQWLMDT

SEQ ID NO: 1435 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (7)..(11): Lactam bridge connecting residues 7 and 11
FTSEYSKYLDERRAQDFVQWLMNT

SEQ ID NO: 1436 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (11)..(15): Lactam bridge connecting residues 11 and 15
FTSEYSKYLDERRAKDFVQWLMNT

SEQ ID NO: 1437 - protein, 31 aa, Artificial Sequence
  Synthetic Polypeptide
  MISC_FEATURE: Glucagon analogue
HSQGTFTSDYARYLDARRAREFIKWLVRGRG

SEQ ID NO: 1438 - protein, 24 aa, Artificial Sequence
  Synthetic Polypeptide
  MISC_FEATURE: Glucagon analogue
  MOD_RES (1)..(1): N-terminal amino group replaced with hydroxy group
  MOD_RES (24)..(24): C-terminal alpha carboxylate replaced with amide
FTSDYSKYLDERRAQDFVQWLMNT

SEQ ID NO: 1439 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MISC_FEATURE (22)..(22): Xaa is Met, Leu or Nle
  MOD_RES (24)..(24): C-terminal alpha carboxylate replaced with amide
FTSXYSKYLXERRAKDFVQWLXNT

SEQ ID NO: 1440 - protein, 29 aa, Artificial Sequence
  Synthetic Polypeptide
  MISC_FEATURE: Glucagon analogue
HSQGTFTSDYSKYLDSCRAQDFVQWLMNT

SEQ ID NO: 1441 - protein, 39 aa, Artificial Sequence; identical to SEQ ID NO: 521
  Synthetic Polypeptide
  MISC_FEATURE: Glucagon Analogue

SEQ ID NO: 1442 - protein, 29 aa, Artificial Sequence
  Synthetic Polypeptide
  MISC_FEATURE: Glucagon analogue
  MOD_RES (24)..(24): 2-butyrolactone bound through thiol group of Cysteine
HSQGTFTSDYSKYLDSRRAQCFVQWLMNT

SEQ ID NO: 1443 - protein, 29 aa, Artificial Sequence
  Synthetic Polypeptide
  MISC_FEATURE: Glucagon Analogue
  MOD_RES (21)..(21): Carboxymethyl group bound through thiol group of Cysteine
HSQGTFTSDYSKYLDSRRAQCFVQWLMNT

SEQ ID NO: 1444 - protein, 39 aa, Homo sapiens
HSQGTFTSDYSRYLDSRRAQDFVQWLRNTGPSSGAPPPS

SEQ ID NO: 1445 - protein, 35 aa, Artificial Sequence; identical to SEQ ID NO: 1346
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(11): Lactam bridge connecting residues 7 and 11
  MISC_FEATURE (10)..(10): Xaa is Asp, Glu, cysteic acid, homoglutamic acid or homocysteic acid
  MISC_FEATURE (22)..(22): Xaa is Met, Leu or Nle
  MISC_FEATURE (23)..(23): Xaa is Asn, Lys, Asp, Glu, cysteic acid and homocysteic acid
  MISC_FEATURE (24)..(24): Xaa is Thr, Asp, Glu, cysteic acid and homocysteic acid
  MISC_FEATURE (25)..(25): Xaa is Cys, Orn, homocysteine or acetyl phenyalanine
  MOD_RES (25)..(25): Pegylated

SEQ ID NO: 1446 - protein, 35 aa, Artificial Sequence; identical to SEQ ID NO: 1347
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MISC_FEATURE (11)..(15): Lactam bridge connecting residues 11 and 15
  MISC_FEATURE (22)..(22): Xaa is Met, Leu or Nle
  MISC_FEATURE (23)..(23): Xaa is Asn, Lys, Asp, Glu, cysteic acid and homocysteic acid
  MISC_FEATURE (24)..(24): Xaa is Thr, Asp, Glu, cysteic acid and homocysteic acid
  MISC_FEATURE (35)..(35): Xaa is Cys, Orn, homocysteine or acetyl phenyalanine
  MOD_RES (35)..(35): Pegylated

SEQ ID NO: 1447 - protein, 24 aa, Artificial Sequence
  Synthetic Polypeptide
  MISC_FEATURE: Glucagon analogue
  MISC_FEATURE (4)..(4): Xaa is glutamic acid, homoglutamic acid, cysteic acid or homocysteic acid
  MISC_FEATURE (7)..(11): Lactam bridge connecting residues 7 and 11
  MISC_FEATURE (10)..(10): Xaa is Glu or Asp
  MISC_FEATURE (22)..(22): Xaa is Met, Leu or Nle
  MISC_FEATURE (23)..(23): Xaa is Asn, Asp or Glu
FTSXYSKYLXERRAQDFVQWLXXT

SEQ ID NO: 1448 - protein, 24 aa, Artificial Sequence
  Synthetic Polypeptide
  MISC_FEATURE: Glucagon analogue
  MISC_FEATURE (4)..(4): Xaa is glutamic acid, homoglutamic acid,  cysteic acid or homocysteic acid
  MISC_FEATURE (10)..(10): Xaa is Asp or Glu
  MISC_FEATURE (11)..(15): Lactam bridge connecting residues 11 and 15
  MISC_FEATURE (22)..(22): Xaa is Met, Leu or Nle
  MISC_FEATURE (23)..(23): Xaa is Asn, Asp or Glu
FTSXYSKYLXERRAKDFVQWLXXT

SEQ ID NO: 1449 - protein, 23 aa, Artificial Sequence
  Synthetic Polypeptide
  MISC_FEATURE: Glucagon analogue
TSDYSKYLDERRAKDFVQWLMDT

SEQ ID NO: 1450 - protein, 11 aa, Artificial Sequence
  Synthetic Polypeptide
  MISC_FEATURE: Peptide fragment representing the carboxy terminal 10 amino acids of Exendin-4 plus one additional amino acid
  MISC_FEATURE (11)..(11): Xaa is selected form the group consisting of Cys, Orn, Lys, homocysteine and acetyl phenyalanine
GPSSGAPPPSX

SEQ ID NO: 1451 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid, homoglutamic acid or homocysteic acid
  MISC_FEATURE (7)..(7): Xaa is Lys or Glu
  MISC_FEATURE (10)..(10): Xaa is Asp, Glu, cysteic acid, homoglutamic acid or homocysteic acid
  MISC_FEATURE (11)..(11): Xaa is Ala, Ser, Glu, Lys Gln, homoglutamic acid or homocysteic acid
  MISC_FEATURE (15)..(15): Xaa is Arg, Gln, Glu or Lys
  MISC_FEATURE (19)..(19): Xaa is Ala, Gln, Lys or Glu
  MISC_FEATURE (22)..(22): Xaa is Met, Leu or Nle
  MISC_FEATURE (23)..(23): Xaa is Asn, Lys or an acidic amino acid
  MISC_FEATURE (24)..(24): Xaa is Thr, Gly or an acidic amino acid
FTSXYSXYLXXRRAXDFVXWLXXX

SEQ ID NO: 1452 - protein, 6 aa, Artificial Sequence
  Synthetic Polypeptide
  MISC_FEATURE (6)..(6): Xaa is phenyl lactic acid
HSQGTX

SEQ ID NO: 1453 - protein, 5 aa, Artificial Sequence
  Synthetic Polypeptide
  MISC_FEATURE (5)..(5): Xaa is phenyl lactic acid
SQGTX

SEQ ID NO: 1454 - protein, 4 aa, Artificial Sequence
  Synthetic Polypeptide
  MISC_FEATURE (4)..(4): Xaa is phenyl lactic acid
QGTX

SEQ ID NO: 1455 - protein, 3 aa, Artificial Sequence
  Synthetic Polypeptide
  MISC_FEATURE (3)..(3): Xaa is phenyl lactic acid
GTX

SEQ ID NO: 1456 - protein, 2 aa, Artificial Sequence
  Synthetic Polypeptide
  MISC_FEATURE (2)..(2): Xaa is phenyl lactic acid
TX

SEQ ID NO: 1457 - protein, 6 aa, Artificial Sequence
  Synthetic Polypeptide
  MISC_FEATURE (1)..(1): Xaa is selected from a group consisting of His, D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and
  MISC_FEATURE (2)..(2): Xaa is selected from a group consisting of Ser, D-serine, D-alanine, Val, Gly, N-methyl serine, N-methyl alanine, and aminoisobutyric acid (AIB)
  MISC_FEATURE (3)..(3): Xaa is selected from a group consisting of Glu or Gln
  MISC_FEATURE (6)..(6): Xaa is phenyl lactic acid
XXXGTX

SEQ ID NO: 1458 - protein, 5 aa, Artificial Sequence
  Synthetic Polypeptide
  MISC_FEATURE (1)..(1): Xaa is selected from a group consisting of Ser, D-serine, D-alanine, Val, Gly, N-methyl serine, N-methyl alanine, and aminoisobutyric acid (AIB)
  MISC_FEATURE (2)..(2): Xaa is selected from a group consisting of Glu or Gln
  MISC_FEATURE (5)..(5): Xaa is phenyl lactic acid
XXGTX

SEQ ID NO: 1459 - protein, 4 aa, Artificial Sequence
  Synthetic Polypeptide
  MISC_FEATURE (1)..(1): Xaa is selected from a group consisting of Glu or Gln
  MISC_FEATURE (4)..(4): Xaa is phenyl lactic acid
XGTX

SEQ ID NO: 1460 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (24)..(24): C-terminal alpha carboxylate replaced with amide
FTSDYSKYLDERRAKDFVQWLMDT

SEQ ID NO: 1461 - protein, 24 aa, Artificial Sequence
  Synthetic Polypeptide
  MOD_RES (1)..(1): N-terminal amino group replaced with hydroxy group
  MOD_RES (24)..(24): C-terminal alpha carboxylate replaced with amide
FTSEYSKYLDSRRAQDFVQWLMNT

SEQ ID NO: 1462 - protein, 24 aa, Artificial Sequence
  Synthetic Polypeptide
  MOD_RES (1)..(1): N-terminal amino group replaced with hydroxy group
  MISC_FEATURE (4)..(7): Lactam bridge connecting residues 4 and 7
  MOD_RES (24)..(24): C-terminal alpha carboxylate replaced with amide
FTSEYSKYLDSRRAQDFVQWLMNT

SEQ ID NO: 1463 - protein, 28 aa, Artificial Sequence
  Synthetic Polypeptide
  MISC_FEATURE (15)..(19): Lactam bridge connecting residues 15 and 19
  MOD_RES (28)..(28): C-terminal alpha carboxylate replaced with amide
AEGTFTSEYSKYLDERRAKDFVQWLMDT

SEQ ID NO: 1464 - protein, 28 aa, Artificial Sequence
  Synthetic Polypeptide
  MISC_FEATURE (4)..(5): Threonine in position 4 and phenyl lactic acid in position 5 are linked via ester bond
  MISC_FEATURE (5)..(5): Xaa is phenyl lactic acid
  MISC_FEATURE (15)..(19): Lactam bridge connecting residues 15 and 19
  MOD_RES (28)..(28): C-terminal alpha carboxylate replaced with amide
AEGTXTSDYSKYLDERRAKDFVQWLMDT

SEQ ID NO: 1465 - protein, 28 aa, Artificial Sequence
  Synthetic Polypeptide
  MISC_FEATURE (15)..(19): Lactam bridge connecting residues 15 and 19
  MOD_RES (28)..(28): C-terminal alpha carboxylate replaced with amide
SQGTFTSEYSKYLDERRAKDFVQWLMDT

SEQ ID NO: 1466 - protein, 28 aa, Artificial Sequence
  Synthetic Polypeptide
  MISC_FEATURE (4)..(5): Threonine in position 4 and phenyl lactic acid in position 5 are linked via ester bond
  MISC_FEATURE (5)..(5): Xaa is phenyl lactic acid
  MISC_FEATURE (15)..(19): Lactam bridge connecting residues 15 and 19
  MOD_RES (28)..(28): C-terminal alpha carboxylate replaced with amide
SQGTXTSDYSKYLDERRAKDFVQWLMDT

SEQ ID NO: 1467 - protein, 24 aa, Artificial Sequence
  Synthetic Polypeptide
  MOD_RES (1)..(1): N-terminal amino group replaced with hydroxy group
  MISC_FEATURE (5)..(5): Covalently linked to a cholesterol acid moiety
  MISC_FEATURE (11)..(15): Lactam bridge connecting residues 11 to 15
  MOD_RES (24)..(24): C-terminal alpha carboxylate replaced with amide
FTSDKSKYLDERRAKDFVQWLMDT

SEQ ID NO: 1468 - protein, 25 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MISC_FEATURE (25)..(25): Covalently linked to a cholesterol acid moiety
  MOD_RES (25)..(25): C-terminal alpha carboxylate replaced with amide
FTSDYSKYLDERRAKDFVQWLMDTK

SEQ ID NO: 1469 - protein, 35 aa, Artificial Sequence
  Synthetic Polypeptide
  MOD_RES (1)..(1): N-terminal amino group replaced with hydroxy group
  MISC_FEATURE (11)..(15): Lactam bridge connectiong residues 11 and 15
  MISC_FEATURE (35)..(35): Covalently linked to a cholesterol acid moiety
  MOD_RES (35)..(35): C-terminal alpha carboxylate replaced with amide
FTSDYSKYLDERRAKDFVQWLMDTGPSSGAPPPSK

SEQ ID NO: 1470 - protein, 28 aa, Artificial Sequence
  Synthetic Polypeptide
  MISC_FEATURE (1)..(1): Xaa is amino isobutyric acid
  MISC_FEATURE (4)..(5): Threonine in position 4 and phenyl lactic acid in position 5 are linked via ester bond
  MISC_FEATURE (5)..(5): Xaa is phenyl lactic acid
  MISC_FEATURE (15)..(19): Lactam bridge connectiong residues 15 and 19
  MOD_RES (28)..(28): C-terminal alpha carboxylate replaced with amide
XEGTXTSDYSKYLDERRAKDFVQWLMDT

SEQ ID NO: 1471 - protein, 34 aa, Artificial Sequence; identical to SEQ ID NO: 1428
  Synthetic Polypeptide
  MOD_RES (34)..(34): C-terminal alpha carboxylate replaced with amide

SEQ ID NO: 1472 - protein, 34 aa, Artificial Sequence; identical to SEQ ID NO: 1428
  Synthetic Polypeptide
  MOD_RES (1)..(1): N-terminal amino group replaced with hydroxy group
  MOD_RES (34)..(34): C-terminal alpha carboxylate replaced with amide

SEQ ID NO: 1473 - protein, 34 aa, Artificial Sequence; identical to SEQ ID NO: 1430
  Synthetic Polypeptide
  MISC_FEATURE (11)..(15): Lactam bridge connecting residues 11 and 15
  MOD_RES (34)..(34): C-terminal alpha carboxylate replaced with amide

SEQ ID NO: 1474 - protein, 34 aa, Artificial Sequence; identical to SEQ ID NO: 1430
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (34)..(34): C-termincal alpha carboxylate replaced with amide

SEQ ID NO: 1475 - protein, 24 aa, Artificial Sequence
  Synthetic Polypeptide
  MOD_RES (1)..(1): N-terminal amino group replaced with hydroxy group
  MISC_FEATURE (7)..(11): Lactam bridge connecting residues 7 and 11
  MOD_RES (24)..(24): C-terminal alpha carboxylate replaced with amide
FTSDYSKYLDERRAQDFVQWLMDT

SEQ ID NO: 1476 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (24)..(24): C-terminal alpha carboxylate replaced with amide
FTSDYSKYLDERRAKDFVQWLMDT

SEQ ID NO: 1477 - protein, 24 aa, Artificial Sequence
  Synthetic Polypeptide
  MOD_RES (1)..(1): N-terminal amino group replaced with hydroxy group
  MISC_FEATURE (15)..(19): Lactam bridge connecting residues 15 and 19
  MOD_RES (24)..(24): C-terminal alpha carboxylate replaced with amide
FTSDYSKYLDERRAKDFVEWLMDT

SEQ ID NO: 1478 - protein, 24 aa, Artificial Sequence
  Synthetic Polypeptide
  MOD_RES (1)..(1): N-terminal amino group replaced with hydroxy group
  MISC_FEATURE (19)..(23): Lactam bridge connecting residues 19 and 23
  MOD_RES (24)..(24): C-terminal alpha carboxylate replaced with amide
FTSDYSKYLDERRAQDFVEWLMKT

SEQ ID NO: 1479 - protein, 24 aa, Artificial Sequence
  Synthetic Polypeptide
  MOD_RES (1)..(1): N-terminal amino group replaced with hydroxy group
  MISC_FEATURE (7)..(11): Lactam bridge connecting residues 7 and 11
  MOD_RES (24)..(24): C-terminal alpha carboxylate replaced with amide
FTSDYSKYLDEQAAKDFIAWLMDT

SEQ ID NO: 1480 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (24)..(24): C-terminal alpha carboxylate replaced with amide
FTSDYSKYLDEQAAKEFIAWLMDT

SEQ ID NO: 1481 - protein, 28 aa, Artificial Sequence
  Synthetic Polypeptide
  MISC_FEATURE (15)..(19): Lactam bridge connecting residues 15 and 19
  MOD_RES (28)..(28): C-terminal alpha carboxylate replaced with amide
AEGTFTSEYSKYLDERRAKDFVQWLMDT

SEQ ID NO: 1482 - protein, 28 aa, Artificial Sequence
  Synthetic Polypeptide
  MISC_FEATURE (15)..(19): Lactam bridge connecting residues 15 and 19
  MOD_RES (28)..(28): C-terminal alpha carboxylate replaced with amide
AEGTFTSEYSKYLDEQAAKEFIAWLMDT

SEQ ID NO: 1483 - protein, 29 aa, Artificial Sequence
  Synthetic Polypeptide
  MISC_FEATURE (16)..(20): Lactam bridge connection residues 16 and 20
  MOD_RES (29)..(29): C-terminal alpha carboxylate replaced with amide
HAEGTFTSEYSKYLDERRAKDFVQWLMDT

SEQ ID NO: 1484 - protein, 29 aa, Artificial Sequence
  Synthetic Polypeptide
  MISC_FEATURE (16)..(20): Lactam bridge connecting bridges 16 and 20
  MOD_RES (29)..(29): C-terminal alpha carboxylate replaced with amide
HAEGTFTSEYSKYLDEQAAKEFIAWLMDT

SEQ ID NO: 1485 - protein, 26 aa, Artificial Sequence
  Synthetic Polypeptide
  MISC_FEATURE (13)..(17): Lactam bridge connecting residues 13 and 17
  MOD_RES (26)..(26): C-terminal alpha carboxylate replaced with amide
GTFTSEYSKYLDERRAKDFVQWLMDT

SEQ ID NO: 1486 - protein, 28 aa, Artificial Sequence
  Synthetic Polypeptide
  MISC_FEATURE (5)..(6): Threonine in position 5 and phenyl lactic acid in position 6 linked via ester bond
  MISC_FEATURE (15)..(19): Lactam bridge connecting residues 15 and 19
  MOD_RES (28)..(28): C-terminal alpha carboxylate replaced with amide
SQGTFTSEYSKYLDERRAKDFVQWLMDT

SEQ ID NO: 1487 - protein, 29 aa, Artificial Sequence
  Synthetic Polypeptide
  MISC_FEATURE (5)..(6): Threonine at position 5 and phenyl lactic acid at position 6 linked via ester bond
  MISC_FEATURE (6)..(6): Xaa is phenyl lactic acid
  MISC_FEATURE (16)..(20): Lactam bridge connecting residues 16 and 20
  MOD_RES (29)..(29): C-terminal alpha carboxylate replaced with amide
HAEGTXTSDYSKYLDERRAKDFVQWLMDT

SEQ ID NO: 1488 - protein, 24 aa, Artificial Sequence
  Synthetic Polypeptide
  MOD_RES (1)..(1): N-terminal amino group replaced with hydroxy group
  MISC_FEATURE (7)..(11): Lactam bridge connecting residues 7 and 11
  MOD_RES (19)..(19): Pegylated
  MOD_RES (24)..(24): C-terminal alpha carboxylate replaced with amide
FTSDYSKYLDERRAQDFVCWLMDT

SEQ ID NO: 1489 - protein, 35 aa, Artificial Sequence
  Synthetic Polypeptide
  MOD_RES (1)..(1): N-terminal amino group replaced with hydroxy group
  MISC_FEATURE (7)..(11): Lactam bridge connecting residues 7 and 11
  MOD_RES (35)..(35): Pegylated
  MOD_RES (35)..(35): C-terminal alpha carboxylate replaced with amide
FTSDYSKYLDERRAQDFVQWLMDTGPSSGAPPPSC

SEQ ID NO: 1490 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (19)..(19): Pegylated
  MOD_RES (24)..(24): C-terminal alpha carboxylate replaced with amide
FTSDYSKYLDERRAKDFVCWLMDT

SEQ ID NO: 1491 - protein, 35 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (35)..(35): Pegylated
  MOD_RES (35)..(35): C-terminal alpha carboxylate replaced with amide
FTSDYSKYLDERRAKDFVQWLMDTGPSSGAPPPSC

SEQ ID NO: 1492 - protein, 24 aa, Artificial Sequence
  Synthetic Polypeptide
  MOD_RES (1)..(1): N-terminal amino group replaced with hydroxy group
  MOD_RES (1)..(1): Covalently attached to a C16 fatty acid
  MISC_FEATURE (11)..(15): Lactam bridge connection residues 11 and 15
  MOD_RES (24)..(24): C-terminal alpha carboxylate replaced with amide
FTSDYSKYLDERRAKDFVQWLMDT

SEQ ID NO: 1493 - protein, 24 aa, Artificial Sequence
  Synthetic Polypeptide
  MOD_RES (1)..(1): N-terminal amino group replaced with hydroxy group
  MOD_RES (5)..(5): Linked to a C16 fatty acid via Glu residue
  MISC_FEATURE (11)..(15): Lactam bridge connecting residues 11 and 15
  MISC_FEATURE (15)..(15): Linked to a C16 fatty acid via Glu residue
  MOD_RES (24)..(24): C-terminal alpha carboxylate replaced with amide
FTSDKSKYLDERRAKDFVQWLMDT

SEQ ID NO: 1494 - protein, 24 aa, Artificial Sequence
  Synthetic Polypeptide
  MOD_RES (1)..(1): N-terminal amino group replaced with hydroxy group
  MISC_FEATURE (15)..(15): Linked to C16 fatty acid via Glu residue
  MOD_RES (24)..(24): C-terminal alpha carboxylate replaced with amide
FTSDYSKYLDERRAKDFVQWLMDT

SEQ ID NO: 1495 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MISC_FEATURE (19)..(19): Linked to a C16 fatty acid via Glu residue
  MOD_RES (24)..(24): C-terminal alpha carboxylate replaced with amide
FTSDYSKYLDERRAKDFVKWLMDT

SEQ ID NO: 1496 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MISC_FEATURE (24)..(24): Linked to a C16 fatty acid via Glu residue
  MOD_RES (24)..(24): C-terminal alpha carboxylate replaced with amide
FTSDYSKYLDERRAKDFVQWLMDK

SEQ ID NO: 1497 - protein, 24 aa, Artificial Sequence
  Synthetic Polypeptide
  MOD_RES (1)..(1): N-terminal amino group replaced with hydroxy group
  MISC_FEATURE (11)..(11): Xaa is amino isobutyric acid
  MOD_RES (24)..(24): C-terminal alpha carboxylate replaced with amide
FTSDYSKYLDXRRAQDFVQWLMNT

SEQ ID NO: 1498 - protein, 24 aa, Artificial Sequence
  Synthetic Polypeptide
  MOD_RES (1)..(1): N-terminal amino group replaced with hydroxy group
  MISC_FEATURE (11)..(11)
  MISC_FEATURE (15)..(15): Xaa is alpha isobutyric acid
  MOD_RES (24)..(24): C-terminal alpha carboxylate replaced with amide
FTSDKSKYLDXRRAXDFVCWLMNT

SEQ ID NO: 1499 - protein, 24 aa, Artificial Sequence
  Synthetic Polypeptide
  MOD_RES (1)..(1): N-terminal amino group replaced with hydroxy group
  MOD_RES (24)..(24): C-terminal alpha carboxylate replaced with amide
FTSDYSKYLDERRAQDFVQWLMNT

SEQ ID NO: 1500 - protein, 24 aa, Artificial Sequence
  Synthetic Polypeptide
  MOD_RES (1)..(1): N-terminal amino group replaced with hydroxy group
  MOD_RES (24)..(24): C-terminal alpha carboxylate replaced with amide
FTSDKSKYLDERRAQDFVCWLMNT

SEQ ID NO: 1501 - protein, 24 aa, Artificial Sequence
  Synthetic Polypeptide
  MISC_FEATURE (4)..(7): Lactam bridge connecting residues 4 and 7
  MOD_RES (11)..(11): Xaa is alpha isobutyric acid
  MOD_RES (24)..(24): C-terminal carboxylate replaced with amide
FTSEYSKYLDXRRAQDFVQWLMNT

SEQ ID NO: 1502 - protein, 24 aa, Artificial Sequence
  Synthetic Polypeptide
  MISC_FEATURE (4)..(7): Lactam bridge connecting residues 4 and 7
  MOD_RES (11)..(11): Xaa is alpha isobutyric acid
  MOD_RES (24)..(24): C-terminal carboxylate replaced with amide
FTSEYSKYLDXRRAQDFVQWLMNT

SEQ ID NO: 1503 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (24)..(24): C-terminal alpha carboxylate replaced with amide
FTSDYSKYLDERRAKEFVQWLMDT

SEQ ID NO: 1504 - protein, 24 aa, Artificial Sequence
  Synthetic Polypeptide
  MOD_RES (1)..(1): N-terminal amino group replaced with hydroxy group
  MOD_RES (24)..(24): C-terminal alpha carboxylate replaced with amide
FTSDYSKYLDEQAAKEFIAWLMNT

SEQ ID NO: 1505 - protein, 34 aa, Artificial Sequence; identical to SEQ ID NO: 1430
  Synthetic Polypeptide
  MOD_RES (34)..(34): C-terminal alpha carboxylate replaced with amide

SEQ ID NO: 1506 - protein, 24 aa, Artificial Sequence
  Synthetic Polypeptide
  MOD_RES (1)..(1): N-terminal amino group replaced with hydroxy group
  MISC_FEATURE (5)..(5): Linked to a C16 fatty acid via Glu residue
  MISC_FEATURE (7)..(7): Linked to a C16 fatty acid via Glu residue
  MOD_RES (24)..(24): C-terminal carboxylate replaced with amide
FTSDKSKYLDERRAKDFVQWLMDT

SEQ ID NO: 1507 - protein, 6 aa, Artificial Sequence
  Synthetic Polypeptide
  MISC_FEATURE (1)..(1): Xaa1 is selected from a group consisting of His, D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and
  MISC_FEATURE (2)..(2): Xaa is selected from a group consisting of Ser, D-serine, D-alanine, valine, glycine, N-methyl serine, and aminoisobutyric acid (AIB)
  MISC_FEATURE (3)..(3): Xaa is selected from a group consisting of Glu or Gln
XXXTGF

SEQ ID NO: 1508 - protein, 5 aa, Artificial Sequence
  Synthetic Polypeptide
  MISC_FEATURE (1)..(1): Xaa is selected from a group consisting of Ser, D-serine, D-alanine, valine, glycine, N-methyl serine, and aminoisobutyric acid (AIB)
  MISC_FEATURE (2)..(2): Xaa is selected from a group consisting of Glu or Gln
XXTGF

SEQ ID NO: 1509 - protein, 4 aa, Artificial Sequence
  Synthetic Polypeptide
  MISC_FEATURE (1)..(1): Xaa is selected from a group consisting of Glu or Gln
XTGF

SEQ ID NO: 1510 - protein, 24 aa, Artificial Sequence
  Synthetic Polypeptide
  MOD_RES (1)..(1): N-terminal amino group replaced with hydroxy group
  MOD_RES (24)..(24): C-terminal alpha carboxylate replaced with amide
FTSDYSKYLDSRRAQDFVQWLMDT

SEQ ID NO: 1511 - protein, 28 aa, Artificial Sequence
  Synthetic Polypeptide
  MOD_RES (28)..(28): C-terminal alpha carboxylate replaced with amide
SQGTFTSEYSKYLDSRRAQDFVQWLMNT

SEQ ID NO: 1512 - protein, 28 aa, Artificial Sequence
  Synthetic Polypeptide
  MISC_FEATURE (4)..(5): Threonine at position 4 and phenyl lactic acid at position 5 linked via ester bond
  MISC_FEATURE (5)..(5): Xaa is phenyl lactic acid
  MOD_RES (28)..(28): C-terminal alpha carboxylate replaced with amide
SQGTXTSEYSKYLDSRRAQDFVQWLMNT

SEQ ID NO: 1513 - protein, 29 aa, Artificial Sequence
  Synthetic Polypeptide
  MISC_FEATURE (5)..(6): Threorine at position 5 and phenyl lactic acid at position 6 linked via ester bond
  MISC_FEATURE (6)..(6): Xaa is phenyl lactic acid
  MOD_RES (29)..(29): C-terminal alpha carboxylate replaced with amide
HSQGTXTSEYSKYLDSRRAQDFVQWLMNT

SEQ ID NO: 1514 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (19)..(19): Pegylated
  MOD_RES (24)..(24): C-terminal alpha carboxylate replaced with amide
FTSEYSKYLDERRAKDFVCWLMNT

SEQ ID NO: 1515 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MISC_FEATURE (19)..(19): Pegylated via spacer
  MOD_RES (24)..(24): C-terminal alpha carboxylate replaced with amide
FTSDYSKYLDERRAKDFVKWLMDT

SEQ ID NO: 1516 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (19)..(19): Pegylated via rigid spacer
  MOD_RES (24)..(24): C-terminal alpha carboxylate replaced with amide
FTSDYSKYLDERRAKDFVKWLMDT

SEQ ID NO: 1517 - protein, 35 aa, Artificial Sequence
  Synthetic Polypeptide
  MISC_FEATURE (1)..(1): N-terminal amino group replaced with hydroxy group
  MISC_FEATURE (11)..(15): Lactam bridge connecting residues 11 and 15
  MOD_RES (35)..(35): Pegylated
  MOD_RES (35)..(35): C-terminal alpha carboxylate replaced with amide
FTSDYSKYLDERRAKDFVQWLMDTGPGPGPGPGPC

SEQ ID NO: 1518 - protein, 35 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (35)..(35): Pegylated
  MOD_RES (35)..(35): C-terminal alpha carboxylate reaplaced with amide
FTSDYSKYLDERRAKDFVQWLMDGGPSSGAPPPSC

SEQ ID NO: 1519-1700 - skipped (182 entries)

SEQ ID NO: 1701 - protein, 29 aa, Artificial Sequence
  Synthetic peptide
  MOD_RES (2)..(2): Xaa is AIB
  misc_feature (16)..(16): Xaa can be any naturally occurring amino acid
  misc_feature (20)..(20): Xaa can be any naturally occurring amino acid
  MOD_RES (29)..(29): C-terminal amidation
HSQGTFTSDYSKYLDXQAAXGFIAWLMNT

SEQ ID NO: 1702 - protein, 29 aa, Artificial Sequence
  Synthetic peptide
  MOD_RES (2)..(2): Xaa is AIB
  MOD_RES (10)..(10): Acylated with C16 fatty acyl group
  MOD_RES (16)..(16): Xaa is AIB
  MOD_RES (29)..(29): C-terminal amidation
HXQGTFTSDKSKYLDXRAAQDFVQWLMDT

SEQ ID NO: 1703 - protein, 29 aa, Artificial Sequence
  Synthetic peptide
  MOD_RES (2)..(2): Xaa is AIB
  MOD_RES (10)..(10): Acylated with C14 fatty acyl group via dipeptide spacer
  MOD_RES (16)..(16): Xaa is AIB
  MOD_RES (29)..(29): C-terminal amidation
HXQGTFTSDKSKYLDXRAAQDFVQWLMDT

SEQ ID NO: 1704 - protein, 29 aa, Artificial Sequence
  Synthetic peptide
  MOD_RES (2)..(2): Xaa is AIB
  MOD_RES (10)..(10): Acylated with C18 fatty acyl group via dipeptide spacer
  MOD_RES (16)..(16): Xaa is AIB
  MOD_RES (29)..(29): C-terminal amidation
HXQGTFTSDKSKYLDXRAAQDFVQWLMDT

SEQ ID NO: 1705 - protein, 29 aa, Artificial Sequence
  Synthetic peptide
  MOD_RES (1)..(10): Acylated with C16 fatty acyl group via dipeptide spacer
  MOD_RES (2)..(2): Xaa is AIB
  MOD_RES (16)..(16): Xaa is AIB
  MOD_RES (29)..(29): C-terminal amidation
HXEGTFTSDKSKYLDXRAAQDFVQWLMDT

SEQ ID NO: 1706 - protein, 29 aa, Artificial Sequence
  Synthetic peptide
  MOD_RES (2)..(2): Xaa is AIB
  MOD_RES (10)..(10): Acylated with C16 fatty acyl group via dipeptide spacer
  MOD_RES (16)..(16): Xaa is AIB
HXQGTFISDKSKYLDXRAAQDFVQWLMDT

SEQ ID NO: 1707 - protein, 29 aa, Artificial Sequence
  Synthetic peptide
  MOD_RES (2)..(2): Xaa is AIB
  MOD_RES (10)..(10): Acylated with C16 fatty acyl group via dipeptide spacer
  MOD_RES (29)..(29): C-terminal amidation
HXQGTFTSDKSKYLDERAAQDFVQWLMDT

SEQ ID NO: 1708 - protein, 29 aa, Artificial Sequence
  Synthetic peptide
  MOD_RES (2)..(2): Xaa is AIB
  MOD_RES (10)..(10): Acylated with C16 fatty acyl group via dipeptide spacer
  MOD_RES (16)..(16): Xaa is AIB
  MOD_RES (29)..(29): C-terminal amidation
HXQGTFTSDKSKYLEXRAAQDFVQWLMDT

SEQ ID NO: 1709 - protein, 29 aa, Artificial Sequence
  Synthetic peptide
  MOD_RES (2)..(2): d-Ser
  MOD_RES (10)..(10): Acylated with C16 fatty acyl group via dipeptide spacer
  MOD_RES (16)..(16): Xaa is AIB
  MOD_RES (29)..(29): C-terminal amidation
HSQGTFTSDKSKYLDXRAAQDFVQWLMDT

SEQ ID NO: 1710 - protein, 29 aa, Artificial Sequence
  Synthetic peptide
  MOD_RES (2)..(2): Xaa is AIB
  MOD_RES (10)..(10): Acylated with C16 fatty acyl group via dipeptide spacer
  MOD_RES (16)..(16): Xaa is AIB
  MOD_RES (29)..(29): C-terminal amidation
HXQGTFTSDKSKYLDXRAAQDFVQWLLDT

SEQ ID NO: 1711 - protein, 29 aa, Artificial Sequence
  Synthetic peptide
  MOD_RES (2)..(2): Xaa is AIB
  MOD_RES (10)..(10): Acylated with C16 fatty acyl group via dipeptide spacer
  MOD_RES (29)..(29): C-terminal amidation
HXQGTFTSDKSKYLDEQAAKEFIAWLLDT

SEQ ID NO: 1712 - protein, 29 aa, Artificial Sequence
  Synthetic peptide
  MOD_RES (2)..(2): Xaa is AIB
  MOD_RES (10)..(10): Acylated with C16 fatty acyl group via gamma-Glu spacer
  MOD_RES (29)..(29): C-terminal amidation
HXQGTFTSDKSKYLDEQAAKEFICWLLDT

SEQ ID NO: 1713 - protein, 29 aa, Artificial Sequence
  Synthetic peptide
  MOD_RES (2)..(2): Xaa is AIB
  MOD_RES (10)..(10): Acylated with C16 fatty acyl group via gamma-Glu spacer
  MOD_RES (24)..(24): PEGYLATION
  MOD_RES (29)..(29): C-terminal amidation
HXQGTFTSDKSKYLDEQAAKEFICWLLDT

SEQ ID NO: 1714 - protein, 29 aa, Artificial Sequence
  Synthetic peptide
  MOD_RES (2)..(2): Xaa is AIB
  MOD_RES (10)..(10): Acylated with C16 fatty acyl group via gamma-Glu spacer
  MOD_RES (24)..(24): PEGYLATION
  MOD_RES (29)..(29): C-terminal amidation
HXQGTFTSDKSKYLDERAAQDFVCWLLDT

SEQ ID NO: 1715 - protein, 30 aa, Artificial Sequence
  Synthetic peptide
  MOD_RES (2)..(2): Xaa is AIB
  MOD_RES (10)..(10): Acylated with C16 fatty acyl group via gamma-Glu spacer
  MOD_RES (30)..(30): PEGYLATION
  MOD_RES (30)..(30): C-terminal amidation
HXQGTFTSDKSKYLDEQAAKEFIQWLLDTC

SEQ ID NO: 1716 - protein, 29 aa, Artificial Sequence
  Synthetic peptide
  MOD_RES (10)..(10): Acylated with C16 fatty acyl group via gamma-Glu spacer
  MOD_RES (24)..(24): PEGYLATION
  MOD_RES (29)..(29): C-terminal amidation
HAQGTFTSDKSKYLDERAAQDFVCWLLDT

SEQ ID NO: 1717 - protein, 29 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (29)..(29): C-terminal amidation
HSQGTFTSDKSKYLDEQAAKEFICWLLDT

SEQ ID NO: 1718 - protein, 29 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (29)..(29): C-terminal amidation
HSQGTFTSDKSKYLDERAAQDFVQWLLDT

SEQ ID NO: 1719 - protein, 29 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (29)..(29): C-terminal amidation
HSQGTFTSDKSKYLDERAAQDFVCWLLDT

SEQ ID NO: 1720 - protein, 29 aa, Artificial Sequence
  Synthetic peptide
  MOD_RES (2)..(2): d-Ser
  MOD_RES (10)..(10): Acylated with C16 fatty acyl group via gamma-Glu spacer
HSQGTFTSDKSKYLDEQAAKEFICWLLDT

SEQ ID NO: 1721 - protein, 31 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (31)..(31): C-terminal amidation
HSQGTFTSDKSKYLDEQAAKEFICWLLDTGE

SEQ ID NO: 1722 - protein, 31 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (24)..(24): PEGYLATION
HSQGTFTSDKSKYLDEQAAKEFICWLLDTGG

SEQ ID NO: 1723 - protein, 29 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (24)..(24): PEGYLATION
  MOD_RES (29)..(29): C-terminal amidation
HSQGTFTSDKSKYLDERAAQDFVCWLLDT

SEQ ID NO: 1724 - protein, 30 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (30)..(30): PEGYLATION
  MOD_RES (30)..(30): C-terminal amidation
HSQGTFTSDKSKYLDERAAQDFVQWLLDTC

SEQ ID NO: 1725 - protein, 30 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (24)..(24): PEGYLATION
  MOD_RES (30)..(30): C-terminal amidation
HSQGTFTSDYSKYLDSRRAQDFVQWLMNTE

SEQ ID NO: 1726 - protein, 30 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (24)..(24): PEGYLATION
HSQGTFTSDKSKYLDEQAAKEFICWLLDTC

SEQ ID NO: 1727 - protein, 29 aa, Artificial Sequence
  Synthetic peptide
  MOD_RES (1)..(1): Xaa is DMIA
  MOD_RES (10)..(10): Acylated with C16 fatty acyl group via gamma-Glu spacer
  MOD_RES (29)..(29): C-terminal amidation
XSQGTFTSDKSKYLDEQAAKEFICWLLDT

SEQ ID NO: 1728 - protein, 29 aa, Artificial Sequence
  Synthetic peptide
  MOD_RES (1)..(1): des-amino-His
  MOD_RES (10)..(10): Acylated with C16 fatty acyl group via gamma-Glu spacer
  MOD_RES (29)..(29): C-terminal amidation
HSQGTFTSDKSKYLDEQAAKEFICWLLDT

SEQ ID NO: 1729 - protein, 29 aa, Artificial Sequence
  Synthetic peptide
  MOD_RES (1)..(1): Ac-His
  MOD_RES (10)..(10): Acylated with C16 fatty acyl group via gamma-Glu spacer
  MOD_RES (24)..(24): PEGYLATION
  MOD_RES (29)..(29): C-terminal amidation
HSQGTFTSDKSKYLDEQAAKEFICWLLDT

SEQ ID NO: 1730 - protein, 29 aa, Artificial Sequence
  Synthetic peptide
  MOD_RES (2)..(2): Xaa is AIB
  MOD_RES (10)..(10): Acylated with C16 fatty acyl group via gamma-Glu spacer
  MOD_RES (29)..(29): C-terminal amidation
HXQGTFTSDKSKYLDEEAVRLFIEWLMNT

SEQ ID NO: 1731 - protein, 29 aa, Artificial Sequence
  Synthetic peptide
  MOD_RES (2)..(2): Xaa is AIB
  MOD_RES (10)..(10): Acylated with C16 fatty acyl group
  MOD_RES (29)..(29): C-terminal amidation
HXQGTFTSDKSKYLDEEAVRLFIEWLMNT

SEQ ID NO: 1732 - protein, 29 aa, Artificial Sequence
  Synthetic peptide
  MOD_RES (2)..(2): Xaa is AIB
  MOD_RES (24)..(24): PEGYLATION
  MOD_RES (29)..(29): C-terminal amidation
HXQGTFTSDYSKYLDEEAVRLFICWLMNT

SEQ ID NO: 1733 - protein, 29 aa, Artificial Sequence
  Synthetic peptide
  MOD_RES (2)..(2): Xaa is AIB
  MOD_RES (29)..(29): C-terminal amidation
HXQGTFTSDYSKYLDEEAVRLFIEWLMNT

SEQ ID NO: 1734 - protein, 29 aa, Artificial Sequence
  Synthetic peptide
  MOD_RES (2)..(2): Xaa is AIB
  MOD_RES (29)..(29): C-terminal amidation
HXQGTFTSDYSKYLDEEAVRLFICWLMNT

SEQ ID NO: 1735 - protein, 29 aa, Artificial Sequence
  Synthetic peptide
  MOD_RES (2)..(2): d-Ser
  MOD_RES (24)..(24): PEGYLATION
  MOD_RES (29)..(29): C-terminal amidation
HSQGTFTSDYSKYLDEEAVRLFICWLMNT

SEQ ID NO: 1736 - protein, 29 aa, Artificial Sequence
  Synthetic peptide
  MOD_RES (2)..(2): d-Ser
  MOD_RES (29)..(29): C-terminal amidation
HSQGTFTSDYSKYLDEEAVRLFIEWLMNT

SEQ ID NO: 1737 - protein, 29 aa, Artificial Sequence
  Synthetic peptide
  MOD_RES (2)..(2): d-Ser
  MOD_RES (29)..(29): C-terminal amidation
HSQGTFTSDYSKYLDEEAVRLFICWLMNT

SEQ ID NO: 1738 - protein, 29 aa, Artificial Sequence
  Synthetic peptide
  MOD_RES (10)..(10): Acylated with C16 fatty acyl group via acidic amino acid spacer
  MOD_RES (29)..(29): C-terminal amidation
HSQGTFTSDKSKYLDEEAVRLFIEWLMNT

SEQ ID NO: 1739 - protein, 29 aa, Artificial Sequence
  Synthetic peptide
  MOD_RES (10)..(10): Acylated with C16 fatty acyl group via gamma-Glu spacer
  MOD_RES (29)..(29): C-terminal amidation
HSQGTFTSDKSKYLDEEAVRLFIEWLMNT

SEQ ID NO: 1740 - protein, 29 aa, Artificial Sequence
  Synthetic peptide
  MOD_RES (2)..(2): Xaa is AIB
  MISC_FEATURE (16)..(20): Salt bridge
  MISC_FEATURE (17)..(21): Salt bridge
  MOD_RES (24)..(24): PEGYLATION
  MOD_RES (29)..(29): C-terminal amidation
HXQGTFTSDYSKYLDEKRAKEFVCWLMNT

SEQ ID NO: 1741 - protein, 29 aa, Artificial Sequence
  Synthetic peptide
  MOD_RES (2)..(2): Xaa is AIB
  MOD_RES (16)..(16): Xaa is AIB
  MISC_FEATURE (16)..(20): Salt bridge
  MISC_FEATURE (17)..(21): Salt bridge
  MOD_RES (24)..(24): PEGYLATION
  MOD_RES (29)..(29): C-terminal amidation
HXQGTFTSDYSKYLDXKRAKEFVCWLMNT

SEQ ID NO: 1742 - protein, 29 aa, Artificial Sequence
  Synthetic peptide
  MOD_RES (2)..(2): d-Ser
  MISC_FEATURE (16)..(20): Salt bridge
  MISC_FEATURE (17)..(21): Salt bridge
  MOD_RES (24)..(24): PEGYLATION
  MOD_RES (29)..(29): C-terminal amidation
HSQGTFTSDYSKYLDEKRAKEFVCWLMNT

SEQ ID NO: 1743 - protein, 29 aa, Artificial Sequence
  Synthetic peptide
  MOD_RES (2)..(2): d-Ser
  MOD_RES (16)..(16): Xaa is AIB
  MISC_FEATURE (16)..(20): Salt bridge
  MISC_FEATURE (17)..(21): Salt bridge
  MOD_RES (24)..(24): PEGYLATION
  MOD_RES (29)..(29): C-terminal amidation
HSQGTFTSDYSKYLDXKRAKEFVCWLMNT

SEQ ID NO: 1744 - protein, 29 aa, Artificial Sequence
  Synthetic peptide
  MOD_RES (2)..(2): d-Ser
  MISC_FEATURE (16)..(20): Salt bridge
  MISC_FEATURE (17)..(21): Salt bridge
  MOD_RES (29)..(29): C-terminal amidation
HSQGTFTSDYSKYLDEKRAKEFVQWLMNT

SEQ ID NO: 1745 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (16)..(16): Xaa is AIB
  MISC_FEATURE (16)..(20): Salt bridge
  MISC_FEATURE (17)..(21): Salt bridge
  MOD_RES (29)..(29): C-terminal amidation
HSQGTFTSDYSKYLDXKRAKEFVQWLMNT

SEQ ID NO: 1746 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via gamma-Glu spacer
  MISC_FEATURE (15)..(20): Salt bridge
  MOD_RES (16)..(16): Xaa is AIB
  MISC_FEATURE (16)..(21): Salt bridge
  MOD_RES (29)..(29): C-terminal amidation
HSQGTFTSDKSKYLDXKRAKEFVQWLMNT

SEQ ID NO: 1747 - protein, 29 aa, Artificial Sequence
  Synthetic peptide
  MOD_RES (1)..(1): Xaa is DMIA
  MOD_RES (16)..(16): Xaa is AIB
  MISC_FEATURE (16)..(20): Salt bridge
  MISC_FEATURE (17)..(21): Salt bridge
  MOD_RES (24)..(24): PEGYLATION
  MOD_RES (29)..(29): C-terminal amidation
XSQGTFTSDYSKYLDXKRAKEFVCWLMNT

SEQ ID NO: 1748 - protein, 29 aa, Artificial Sequence
  Synthetic peptide
  MISC_FEATURE (16)..(20): Salt bridge
  MISC_FEATURE (17)..(21): Salt bridge
  MOD_RES (29)..(29): C-terminal amidation
HSQGTFTSDYSKYLDEKRAKEFVQWLMNT

SEQ ID NO: 1749 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via dipeptide spacer
  MOD_RES (16)..(16): Xaa is AIB
  MOD_RES (29)..(29): C-terminal amidation
HXQGTFTSDKSKYLDXRAAQDFVQWLMDT

SEQ ID NO: 1750 - protein, 29 aa, Artificial Sequence
  Synthetic peptide
  MOD_RES (2)..(2): Xaa is AIB
  MOD_RES (10)..(10): Acylated with C16 fatty acyl group via acidic amino acid spacer
  MOD_RES (29)..(29): C-terminal amidation
HXQGTFTSDKSKYLDEQAAKEFICWLLDT

SEQ ID NO: 1751 - protein, 29 aa, Artificial Sequence
  Synthetic peptide
  MOD_RES (2)..(2): Xaa is AIB
  MOD_RES (10)..(10): Acylated with C16 fatty acyl group via acidic amino acid spacer
  MOD_RES (24)..(24): PEGYLATION
  MOD_RES (29)..(29): C-terminal amidation
HXQGTFTSDKSKYLDEQAAKEFICWLLDT

SEQ ID NO: 1752 - protein, 29 aa, Artificial Sequence
  Synthetic peptide
  MOD_RES (2)..(2): Xaa is AIB
  MOD_RES (10)..(10): Acylated with C16 fatty acyl group via acidic amino acid spacer
  MOD_RES (24)..(24): PEGYLATION
  MOD_RES (29)..(29): C-terminal amidation
HXQGTFTSDKSKYLDERAAQDFVCWLLDT

SEQ ID NO: 1753 - protein, 30 aa, Artificial Sequence; identical to SEQ ID NO: 1715
  Synthetic peptide
  MOD_RES (2)..(2): Xaa is AIB
  MOD_RES (10)..(10): Acylated with C16 fatty acyl group via acidic amino acid spacer
  MOD_RES (30)..(30): PEGYLATION
  MOD_RES (30)..(30): C-terminal amidation

SEQ ID NO: 1754 - protein, 29 aa, Artificial Sequence
  Synthetic peptide
  MOD_RES (10)..(10): Acylated with C16 fatty acyl group via acidic amino acid spacer
  MOD_RES (24)..(24): PEGYLATION
  MOD_RES (29)..(29): C-terminal amidation
HAQGTFTSDKSKYLDERAAQDFVCWLLDT

SEQ ID NO: 1755 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (29)..(29): C-terminal amidation
HXQGTFTSDKSKYLDEQAAKEFICWLLDT

SEQ ID NO: 1756 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (29)..(29): C-terminal amidation
HXQGTFTSDKSKYLDERAAQDFVQWLLDT

SEQ ID NO: 1757 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (29)..(29): C-terminal amidation
HXQGTFTSDKSKYLDERAAQDFVCWLLDT

SEQ ID NO: 1758 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
HXQGTFTSDKSKYLDEQAAKEFICWLLDT

SEQ ID NO: 1759 - protein, 31 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (31)..(31): C-terminal amidation
HXQGTFTSDKSKYLDEQAAKEFICWLLDTGE

SEQ ID NO: 1760 - protein, 31 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (24)..(24): PEGYLATION
HXQGTFTSDKSKYLDEQAAKEFICWLLDTGG

SEQ ID NO: 1761 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (24)..(24): PEGYLATION
  MOD_RES (29)..(29): C-terminal amidation
HXQGTFTSDKSKYLDERAAQDFVCWLLDT

SEQ ID NO: 1762 - protein, 30 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (30)..(30): PEGYLATION
  MOD_RES (30)..(30): C-terminal amidation
HXQGTFTSDKSKYLDERAAQDFVQWLLDTC

SEQ ID NO: 1763 - protein, 30 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (24)..(24): PEGYLATION
  MOD_RES (30)..(30): C-terminal amidation
HXQGTFTSDYSKYLDSRRAQDFVQWLMNTE

SEQ ID NO: 1764 - protein, 30 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (24)..(24): PEGYLATION
HXQGTFTSDKSKYLDEQAAKEFICWLLDTC

SEQ ID NO: 1765 - protein, 29 aa, Artificial Sequence
  Synthetic peptide
  MOD_RES (1)..(1): Xaa is DMIA
  MOD_RES (10)..(10): Acylated with C16 fatty acyl group via acidic amino acid spacer
  MOD_RES (29)..(29): C-terminal amidation
XSQGTFTSDKSKYLDEQAAKEFICWLLDT

SEQ ID NO: 1766 - protein, 29 aa, Artificial Sequence
  Synthetic peptide
  MOD_RES (1)..(1): des-amino-His
  MOD_RES (10)..(10): Acylated with C16 fatty acyl group via acidic amino acid spacer
  MOD_RES (29)..(29): C-terminal amidation
HSQGTFTSDKSKYLDEQAAKEFICWLLDT

SEQ ID NO: 1767 - protein, 29 aa, Artificial Sequence
  Synthetic peptide
  MOD_RES (1)..(1): Ac-His
  MOD_RES (10)..(10): Acylated with C16 fatty acyl group via acidic amino acid spacer
  MOD_RES (24)..(24): PEGYLATION
  MOD_RES (29)..(29): C-terminal amidation
HSQGTFTSDKSKYLDEQAAKEFICWLLDT

SEQ ID NO: 1768 - protein, 29 aa, Artificial Sequence
  Synthetic peptide
  MOD_RES (2)..(2): Xaa is AIB
  MOD_RES (10)..(10): Acylated with C16 fatty acyl group via acidic amino acid spacer
  MOD_RES (29)..(29): C-terminal amidation
HXQGTFTSDKSKYLDEEAVRLFIEWLMNT

SEQ ID NO: 1769 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (24)..(24): PEGYLATION
  MOD_RES (29)..(29): C-terminal amidation
HXQGTFTSDYSKYLDEEAVRLFICWLMNT

SEQ ID NO: 1770 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (29)..(29): C-terminal amidation
HXQGTFTSDYSKYLDEEAVRLFIEWLMNT

SEQ ID NO: 1771 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (29)..(29): C-terminal amidation
HXQGTFTSDYSKYLDEEAVRLFICWLMNT

SEQ ID NO: 1772 - protein, 29 aa, Artificial Sequence
  Synthetic peptide
  MOD_RES (10)..(10): Acylated with C16 fatty acyl group via acidic amino acid spacer
  MOD_RES (29)..(29): C-terminal amidation
HSQGTFTSDKSKYLDEEAVRLFIEWLMNT

SEQ ID NO: 1773 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MISC_FEATURE (16)..(20): Salt bridge
  MISC_FEATURE (17)..(21): Salt bridge
  MOD_RES (24)..(24): PEGYLATION
  MOD_RES (29)..(29): C-terminal amidation
HXQGTFTSDYSKYLDEKRAKEFVCWLMNT

SEQ ID NO: 1774 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (16)..(16): Xaa is AIB
  MISC_FEATURE (16)..(20): Salt bridge
  MISC_FEATURE (17)..(21): Salt bridge
  MOD_RES (24)..(24): PEGYLATION
  MOD_RES (29)..(29): C-terminal amidation
HSQGTFTSDYSKYLDXKRAKEFVCWLMNT

SEQ ID NO: 1775 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MISC_FEATURE (16)..(20): Salt bridge
  MISC_FEATURE (17)..(21): Salt bridge
  MOD_RES (29)..(29): C-terminal amidation
HSQGTFTSDYSKYLDEKRAKEFVQWLMNT

SEQ ID NO: 1776 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MISC_FEATURE (15)..(20): Salt bridge
  MOD_RES (16)..(16): Xaa is AIB
  MISC_FEATURE (16)..(21): Salt bridge
  MOD_RES (29)..(29): C-terminal amidation
HSQGTFTSDKSKYLDXKRAKEFVQWLMNT

SEQ ID NO: 1777-1800 - skipped (24 entries)

SEQ ID NO: 1801 - protein, 37 aa, Homo sapiens
HSQGTFTSDYSKYLDSRRAQDFVQWLMNTKRNRNNIA

SEQ ID NO: 1802 - protein, 37 aa, Artificial Sequence
  OXM analog
HSEGTFTSDYSKYLDSRRAQDFVQWLMNTKRNRNNIA

SEQ ID NO: 1803 - protein, 37 aa, Artificial Sequence
  OXM analog
HSDGTFTSDYSKYLDSRRAQDFVQWLMNTKRNRNNIA

SEQ ID NO: 1804 - protein, 38 aa, Artificial Sequence
  OXM analog
  MOD_RES (2)..(2): Xaa=Aminoisobutyric acid
  MOD_RES (38)..(38): C-terminal amidation
HXQGTFTSDYSKYLDSRRAQDFVQWLMNTKRNRNNIAC

SEQ ID NO: 1805 - protein, 38 aa, Artificial Sequence
  OXM analog
  MOD_RES (2)..(2): Xaa=D-serine
  MOD_RES (38)..(38): Xaa=Cys(mPEG)5kDa
  MOD_RES (38)..(38): C-terminal amidation
HXQGTFTSDYSKYLDSRRAQDFVQWLMNTKRNRNNIAX

SEQ ID NO: 1806 - protein, 38 aa, Artificial Sequence; identical to SEQ ID NO: 1805
  OXM analog
  MOD_RES (2)..(2): Xaa=D-serine
  MOD_RES (38)..(38): Xaa=Cys(mPEG)20kDa
  MOD_RES (38)..(38): C-terminal amidation

SEQ ID NO: 1807 - protein, 38 aa, Artificial Sequence; identical to SEQ ID NO: 1805
  OXM analog
  MOD_RES (2)..(2): Xaa=D-serine
  MOD_RES (38)..(38): Xaa=Cys(mPEG)2 40kDa
  MOD_RES (38)..(38): C-terminal amidation

SEQ ID NO: 1808 - protein, 38 aa, Artificial Sequence; identical to SEQ ID NO: 1805
  OXM analog
  MOD_RES (2)..(2): Xaa=D-serine
  MOD_RES (38)..(38): Xaa=Cys(9cholest-5-en-3-yl{[(2R)-3-amino-2-(amino) -3-oxopropyl]thio}acetate)
  MOD_RES (38)..(38): C-terminal amidation

SEQ ID NO: 1809 - protein, 38 aa, Artificial Sequence; identical to SEQ ID NO: 1805
  OXM analog
  MOD_RES (2)..(2): Xaa=Aminoisobutyric acid
  MOD_RES (38)..(38): Xaa=Cys(mPEG)5kDa
  MOD_RES (38)..(38): C-terminal amidation

SEQ ID NO: 1810 - protein, 38 aa, Artificial Sequence; identical to SEQ ID NO: 1805
  OXM analog
  MOD_RES (2)..(2): Xaa=aminoisobutyric acid
  MOD_RES (38)..(38): Xaa=Cys(mPEG)20kDa
  MOD_RES (38)..(38): C-terminal amidation

SEQ ID NO: 1811 - protein, 38 aa, Artificial Sequence; identical to SEQ ID NO: 1805
  OXM analog
  MOD_RES (2)..(2): X=aminoisobutyric acid
  MOD_RES (38)..(38): Xaa=Cys(mPEG)2 40kDa
  MOD_RES (38)..(38): C-terminal amidation

SEQ ID NO: 1812 - protein, 38 aa, Artificial Sequence; identical to SEQ ID NO: 1805
  OXM analog
  MOD_RES (2)..(2): Xaa=aminoisobutyric acid
  MOD_RES (38)..(38): Xaa=Cys(cholest-5-en-3-yl{[(2R)-3-amino-2-(amino)- 3-oxopropyl]thio}acetate)
  MOD_RES (38)..(38): C-terminal amidation

SEQ ID NO: 1813 - protein, 38 aa, Artificial Sequence
  OXM analog
  MOD_RES (2)..(2): Xaa=aminoisobutyric acid
  MOD_RES (27)..(27): Xaa=methionine sulfoxide
  MOD_RES (38)..(38): Xaa=Cys(mPEG)240kDa
  MOD_RES (38)..(38): C-terminal amidation
HXQGTFTSDYSKYLDSRRAQDFVQWLXNTKRNRNNIAX

SEQ ID NO: 1814 - protein, 38 aa, Artificial Sequence; identical to SEQ ID NO: 1813
  OXM analog
  MOD_RES (2)..(2): Xaa=Aib
  MOD_RES (27)..(27): Xaa=methionine sulfoxide
  MOD_RES (38)..(38): Xaa=Cys(mPEG)260kDa
  MOD_RES (38)..(38): C-terminal amidation

SEQ ID NO: 1815 - protein, 37 aa, Artificial Sequence
  OXM analog
  MOD_RES (2)..(2): Xaa=Aib
  MOD_RES (20)..(20): Xaa=Cys(mPEG)240kDa
  MOD_RES (37)..(37): C-terminal amidation
HXQGTFTSDYSKYLDSRRAXDFVQWLMNTKRNRNNIA

SEQ ID NO: 1816 - protein, 37 aa, Artificial Sequence
  OXM analog
  MOD_RES (2)..(2): Xaa=Aib
  MOD_RES (21)..(21): Xaa=Cys(mPEG)240kDa
  MOD_RES (37)..(37): C-terminal amidation
HXQGTFTSDYSKYLDSRRAQXFVQWLMNTKRNRNNIA

SEQ ID NO: 1817 - protein, 37 aa, Artificial Sequence
  OXM analog
  MOD_RES (2)..(2): Aib
  MOD_RES (24)..(24): Xaa=Cys(mPEG)240kDa
  MOD_RES (27)..(27): Xaa=metionine sulfoxide
  MOD_RES (37)..(37): C-terminal amidation
HXQGTFTSDYSKYLDSRRAQDFVXWLXNTKRNRNNIA

SEQ ID NO: 1818 - protein, 37 aa, Artificial Sequence
  OXM analog
  MOD_RES (2)..(2): Xaa=Aib
  MOD_RES (28)..(28): Xaa=Cys(mPEG)240kDa
  MOD_RES (37)..(37): C-terminal amidation
HXQGTFTSDYSKYLDSRRAQDFVQWLMXTKRNRNNIA

SEQ ID NO: 1819 - protein, 38 aa, Artificial Sequence; identical to SEQ ID NO: 1805
  OXM analog
  MOD_RES (2)..(2): Xaa=D-serine
  MOD_RES (38)..(38): Xaa=Lys(palmitoyl)
  MOD_RES (38)..(38): C-terminal amidation

SEQ ID NO: 1820 - protein, 38 aa, Artificial Sequence
  OXM analog
  MOD_RES (1)..(1): Xaa=desamino-His (deltaNH2-H)
  MOD_RES (2)..(2): Xaa=Aib
  MOD_RES (27)..(27): Xaa=mrtionine sulfoxide
  MOD_RES (38)..(38): Xaa=Cys(mPEG)240kDa
  MOD_RES (38)..(38): C-terminal amidation
XXQGTFTSDYSKYLDSRRAQDFVQWLXNTKRNRNNIAX

SEQ ID NO: 1821 - protein, 38 aa, Artificial Sequence; identical to SEQ ID NO: 1805
  OXM analog
  MOD_RES (2)..(2): xaa=D-serine
  MOD_RES (38)..(38): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (38)..(38): C-terminal amidation

SEQ ID NO: 1822 - protein, 37 aa, Artificial Sequence
  OXM analog
  MOD_RES (2)..(2): Xaa=Aib
  MOD_RES (11)..(11): Xaa=Cys(mPEG)240kDa
  MOD_RES (27)..(27): Xaa=methionine sulfoxide
  MOD_RES (37)..(37): C-terminal amidation
HXQGTFTSDYXKYLDSRRAQDFVQWLXNTKRNRNNIA

SEQ ID NO: 1823 - protein, 37 aa, Artificial Sequence
  OXM analog
  MOD_RES (2)..(2): Xaa=Aib
  MOD_RES (12)..(12): Xaa=Cys(mPEG)240kDa
  MOD_RES (27)..(27): Xaa=Methionine sulfoxide
  MOD_RES (37)..(37): C-terminal amidation
HXQGTFTSDYSXYLDSRRAQDFVQWLXNTKRNRNNIA

SEQ ID NO: 1824 - protein, 38 aa, Artificial Sequence; identical to SEQ ID NO: 1805
  OXM analog
  MOD_RES (2)..(2): Xaa=Aib
  MOD_RES (38)..(38): Xaa=Lys(palmitoyl)
  MOD_RES (38)..(38): C-terminal amidation

SEQ ID NO: 1825 - protein, 38 aa, Artificial Sequence
  OXM analog
  MOD_RES (2)..(2): Xaa=Aib
  MOD_RES (27)..(27): Xaa=Nle
  MOD_RES (38)..(38): C-terminal amidation
HXQGTFTSDYSKYLDSRRAQDFVQWLXNTKRNRNNIAC

SEQ ID NO: 1826 - protein, 38 aa, Artificial Sequence; identical to SEQ ID NO: 1825
  OXM analog
  MOD_RES (2)..(2): Xaa=Aib
  MOD_RES (27)..(27): Xaa=O-methyl-L-homoserine
  MOD_RES (38)..(38): C-terminal amidation

SEQ ID NO: 1827 - protein, 38 aa, Artificial Sequence; identical to SEQ ID NO: 1813
  OXM analog
  MOD_RES (2)..(2): Xaa=Aib
  MOD_RES (27)..(27): Xaa=Nle
  MOD_RES (38)..(38): Xaa=Cys(cholest-5-en-3-yl{[(2R)-3-amino-2-(amino)- 3-oxopropyl]thio}acetate)
  MOD_RES (38)..(38): C-terminal amidation

SEQ ID NO: 1828 - protein, 38 aa, Artificial Sequence; identical to SEQ ID NO: 1813
  OXM analog
  MOD_RES (2)..(2): Xaa=Aib
  MOD_RES (27)..(27): Xaa=O-methyl-L-homoserine
  MOD_RES (38)..(38): Xaa=Cys(cholest-5-en-3-yl{[(2R)-3-amino-2-(amino)- 3-oxopropyl]thio}acetate)
  MOD_RES (38)..(38): C-terminal amidation

SEQ ID NO: 1829 - protein, 38 aa, Artificial Sequence; identical to SEQ ID NO: 1805
  OXM analog
  MOD_RES (2)..(2): Xaa=Aib
  MOD_RES (38)..(38): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (38)..(38): C-terminal amidation

SEQ ID NO: 1830 - protein, 38 aa, Artificial Sequence; identical to SEQ ID NO: 1804
  OXM analog
  MOD_RES (2)..(2): Xaa=D-serine
  MOD_RES (38)..(38): C-terminal amidation

SEQ ID NO: 1831 - protein, 38 aa, Artificial Sequence; identical to SEQ ID NO: 1813
  OXM analog
  MOD_RES (2)..(2): Xaa=D-serine
  MOD_RES (27)..(27): Xaa=metionine sulfoxide
  MOD_RES (38)..(38): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (38)..(38): C-terminal amidation

SEQ ID NO: 1832 - protein, 38 aa, Artificial Sequence; identical to SEQ ID NO: 1813
  OXM analog
  MOD_RES (2)..(2): Xaa=D-serine
  MOD_RES (27)..(27): Xaa=methionine sulfoxide
  MOD_RES (38)..(38): Xaa=Cys(CH2CONH2)
  MOD_RES (38)..(38): C-terminal amidation

SEQ ID NO: 1833 - protein, 37 aa, Artificial Sequence
  OXM analog
  MOD_RES (2)..(2): Xaa=1-Amino-1-cyclohexane carboxylic acid
  MOD_RES (37)..(37): C-terminal amidation
HXQGTFTSDYSKYLDSRRAQDFVQWLMNTKRNRNNIA

SEQ ID NO: 1834 - protein, 37 aa, Artificial Sequence; identical to SEQ ID NO: 1833
  OXM analog
  MOD_RES (2)..(2): Xaa=Abu
  MOD_RES (37)..(37): C-terminal amidation

SEQ ID NO: 1835 - protein, 37 aa, Artificial Sequence; identical to SEQ ID NO: 1833
  OXM analog
  MOD_RES (2)..(2): Xaa=D-abu
  MOD_RES (37)..(37): C-terminal amidation

SEQ ID NO: 1836 - protein, 37 aa, Artificial Sequence; identical to SEQ ID NO: 1833
  OXM analog
  MOD_RES (2)..(2): Xaa=Nva (Aminovaleric acid)
  MOD_RES (37)..(37): C-terminal amidation

SEQ ID NO: 1837 - protein, 37 aa, Artificial Sequence; identical to SEQ ID NO: 1833
  OXM analog
  MOD_RES (2)..(2): Xaa= beta-cyclopropyl-alanine
  MOD_RES (37)..(37): C-terminal amidation

SEQ ID NO: 1838 - protein, 37 aa, Artificial Sequence; identical to SEQ ID NO: 1833
  OXM analog
  MOD_RES (2)..(2): Xaa=propargylglycine
  MOD_RES (37)..(37): C-terminal amidation

SEQ ID NO: 1839 - protein, 37 aa, Artificial Sequence; identical to SEQ ID NO: 1833
  OXM analog
  MOD_RES (2)..(2): Xaa=Allylglycine
  MOD_RES (37)..(37): C-terminal amidation

SEQ ID NO: 1840 - protein, 37 aa, Artificial Sequence; identical to SEQ ID NO: 1833
  OXM analog
  MOD_RES (2)..(2): Xaa=2-Amino-2-cyclohexyl-propanoic acid
  MOD_RES (37)..(37): C-terminal amidation

SEQ ID NO: 1841 - protein, 37 aa, Artificial Sequence; identical to SEQ ID NO: 1833
  OXM analog
  MOD_RES (2)..(2): Xaa=D-tertbutylglycine
  MOD_RES (37)..(37): C-terminal amidation

SEQ ID NO: 1842 - protein, 37 aa, Artificial Sequence; identical to SEQ ID NO: 1833
  OXM analog
  MOD_RES (2)..(2): Xaa=Vinylglycine
  MOD_RES (37)..(37): C-terminal amidation

SEQ ID NO: 1843 - protein, 37 aa, Artificial Sequence; identical to SEQ ID NO: 1833
  OXM analog
  MOD_RES (2)..(2): Xaa=1-Amino-1-cyclopropane carboxylic acid
  MOD_RES (37)..(37): C-terminal amidation

SEQ ID NO: 1844 - protein, 37 aa, Artificial Sequence; identical to SEQ ID NO: 1833
  OXM analog
  MOD_RES (2)..(2): Xaa=1-Amino-1-cyclobutane carboxylic acid
  MOD_RES (37)..(37): C-terminal amidation

SEQ ID NO: 1845 - protein, 37 aa, Artificial Sequence; identical to SEQ ID NO: 1833
  OXM analog
  MOD_RES (2)..(2): Xaa=1-Amino-1-cyclopentane carboxylic acid
  MOD_RES (37)..(37): C-terminal amidation

SEQ ID NO: 1846 - protein, 38 aa, Artificial Sequence
  OXM analog
  MOD_RES (2)..(2): Xaa=D-serine
  MOD_RES (38)..(38): C-terminal amidation
HXQGTFTSDYSKYLDSEAAQDFVQWLMNTKRNRNNIAC

SEQ ID NO: 1847 - protein, 31 aa, Artificial Sequence
  OXM analog
  MOD_RES (2)..(2): Xaa=D-serine
  MOD_RES (31)..(31): C-terminal amidation
HXQGTFTSDYSKYLDSRRAQDFVQWLMNTKC

SEQ ID NO: 1848 - protein, 31 aa, Artificial Sequence
  OXM analog
  MOD_RES (2)..(2): Xaa=D-serine
  MOD_RES (31)..(31): C-terminal amidation
HXQGTFTSDYSKYLDSEAAQDFVQWLMNTKC

SEQ ID NO: 1849 - protein, 31 aa, Artificial Sequence
  OXM analog
  MOD_RES (2)..(2): Xaa=D-serine
  MOD_RES (31)..(31): C-terminal amidation
HXQGTFTSDYSKYLDSERAQDFVQWLMNTKC

SEQ ID NO: 1850 - protein, 31 aa, Artificial Sequence
  OXM analog
  MOD_RES (2)..(2): Xaa=D-serine
  MOD_RES (31)..(31): C-terminal amidation
HXQGTFTSDYSKYLDSRAAQDFVQWLMNTKC

SEQ ID NO: 1851 - protein, 38 aa, Artificial Sequence
  OXM analog
  MOD_RES (2)..(2): Xaa=D-serine
  MOD_RES (38)..(38): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (38)..(38): C-terminal amidation
HXQGTFTSDYSKYLDSEAAQDFVQWLMNTKRNRNNIAX

SEQ ID NO: 1852 - protein, 31 aa, Artificial Sequence
  OXM analog
  MOD_RES (2)..(2): Xaa=D-serine
  MOD_RES (31)..(31): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (31)..(31): C-terminal amidation
HXQGTFTSDYSKYLDSRRAQDFVQWLMNTKX

SEQ ID NO: 1853 - protein, 31 aa, Artificial Sequence
  OXM analog
  MOD_RES (2)..(2): X=D-serine
  MOD_RES (31)..(31): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (31)..(31): C-terminal amidation
HXQGTFTSDYSKYLDSEAAQDFVQWLMNTKX

SEQ ID NO: 1854 - protein, 31 aa, Artificial Sequence
  OXM analog
  MOD_RES (2)..(2): Xaa=D-serine
  MOD_RES (31)..(31): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (31)..(31): C-terminal amidation
HXQGTFTSDYSKYLDSERAQDFVQWLMNTKX

SEQ ID NO: 1855 - protein, 31 aa, Artificial Sequence
  OXM analog
  MOD_RES (2)..(2): Xaa=D-serine
  MOD_RES (31)..(31): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (31)..(31): C-terminal amidation
HXQGTFTSDYSKYLDSRAAQDFVQWLMNTKX

SEQ ID NO: 1856 - protein, 31 aa, Artificial Sequence; identical to SEQ ID NO: 1852
  OXM analog
  MOD_RES (2)..(2): Xaa=D-serine
  MOD_RES (31)..(31): Xaa=Lys(Palmitoyl)
  MOD_RES (31)..(31): C-terminal amidation

SEQ ID NO: 1857 - protein, 31 aa, Artificial Sequence; identical to SEQ ID NO: 1853
  OXM analog
  MOD_RES (2)..(2): Xaa=D-serine
  MOD_RES (31)..(31): Xaa=Lys(palmitoyl)
  MOD_RES (31)..(31): C-terminal amidation

SEQ ID NO: 1858 - protein, 32 aa, Artificial Sequence
  OXM analog
  MOD_RES (2)..(2): Xaa=D-serine
  MOD_RES (31)..(31): Xaa=Ttds
  MOD_RES (32)..(32): Xaa=Lys(Palmitoyl)
  MOD_RES (32)..(32): C-terminal amidation
HXQGTFTSDYSKYLDSRRAQDFVQWLMNTKXX

SEQ ID NO: 1859 - protein, 32 aa, Artificial Sequence
  OXM analog
  MOD_RES (2)..(2): Xaa=D-serine
  MOD_RES (31)..(31): Xaa=Ttds
  MOD_RES (32)..(32): Xaa=Lys(Palmitoyl)
  MOD_RES (32)..(32): C-terminal amidation
HXQGTFTSDYSKYLDSEAAQDFVQWLMNTKXX

SEQ ID NO: 1860 - protein, 32 aa, Artificial Sequence; identical to SEQ ID NO: 1858
  OXM analog
  MOD_RES (2)..(2): Xaa=D-serine
  MOD_RES (31)..(31): Xaa=gamma glutamic acid
  MOD_RES (32)..(32): Xaa=Cys(cholest-5-en-3-yl{[(2R)-3-amino-2-(amino)- 3-oxopropyl]thio}acetate)
  MOD_RES (32)..(32): C-terminal amidation

SEQ ID NO: 1861 - protein, 32 aa, Artificial Sequence; identical to SEQ ID NO: 1859
  OXM analog
  MOD_RES (2)..(2): Xaa=D-serine
  MOD_RES (31)..(31): Xaa=gamma glutamic acid
  MOD_RES (32)..(32): Xaa=Cys(cholest-5-en-3-yl{[(2R)-3-amino-2-(amino)- 3-oxopropyl]thio}acetate)
  MOD_RES (32)..(32): C-terminal amidation

SEQ ID NO: 1862 - protein, 31 aa, Artificial Sequence; identical to SEQ ID NO: 1853
  OXM analog
  MOD_RES (2)..(2): Xaa=Aib
  MOD_RES (31)..(31): Xaa= Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (31)..(31): C-terminal amidation

SEQ ID NO: 1863 - protein, 39 aa, Artificial Sequence
  OXM analog
  MOD_RES (2)..(2): Xaa=D-serine
  MOD_RES (38)..(38): Xaa=gamma glutamic acid
  MOD_RES (39)..(39): Xaa=Cys(cholest-5-en-3-yl{[(2R)-3-amino-2-(amino)- 3-oxopropyl]thio}acetate)
  MOD_RES (39)..(39): C-terminal amidation
HXQGTFTSDYSKYLDSEAAQDFVQWLMNTKRNRNNIAXX

SEQ ID NO: 1864 - protein, 32 aa, Artificial Sequence
  OXM analog
  MOD_RES (2)..(2): Xaa=D-serine
  MOD_RES (32)..(32): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (32)..(32): C-terminal amidation
HXQGTFTSDYSKYLDSEAAQDFVQWLMNTKRX

SEQ ID NO: 1865 - protein, 38 aa, Artificial Sequence; identical to SEQ ID NO: 1851
  OXM analog
  MOD_RES (2)..(2): Xaa=D-serine
  MOD_RES (38)..(38): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))

SEQ ID NO: 1866 - protein, 31 aa, Artificial Sequence; identical to SEQ ID NO: 1854
  OXM analog
  MOD_RES (2)..(2): Xaa=Aib
  MOD_RES (31)..(31): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (31)..(31): C-terminal amidation

SEQ ID NO: 1867 - protein, 32 aa, Artificial Sequence; identical to SEQ ID NO: 1858
  OXM analog
  MOD_RES (2)..(2): Xaa=Aib
  MOD_RES (31)..(31): Xaa=gamma glutamic acid
  MOD_RES (32)..(32): Xaa=Cys(cholest-5-en-3-yl{[(2R)-3-amino-2-(amino)- 3-oxopropyl]thio}acetate)

SEQ ID NO: 1868 - protein, 39 aa, Artificial Sequence; identical to SEQ ID NO: 1863
  OXM analog
  MOD_RES (2)..(2): Xaa=D-serine
  MOD_RES (38)..(38): Xaa=gamma glutamic acid
  MOD_RES (39)..(39): Xaa=Lys(Palmitoyl)
  MOD_RES (39)..(39): C-terminal amidation

SEQ ID NO: 1869 - protein, 33 aa, Artificial Sequence
  OXM analog
  MOD_RES (2)..(2): Xaa=D-serine
  MOD_RES (31)..(32): Xaa=gamma glutamic acid
  MOD_RES (33)..(33): Xaa=Cys(cholest-5-en-3-yl{[(2R)-3-amino-2-(amino)- 3-oxopropyl]thio}acetate)
HXQGTFTSDYSKYLDSRRAQDFVQWLMNTKXXX

SEQ ID NO: 1870 - protein, 32 aa, Artificial Sequence
  OXM analog
  MOD_RES (2)..(2): Xaa=D-serine
  MOD_RES (31)..(31): Xaa=gamma glutamic acid
  MOD_RES (32)..(32): Xaa=Cys(cholest-5-en-3-yl 1{[(2R)-3-amino-2-(amino)-3-oxopropyl]thio}acetate )
HXQGTFTSDYSSYLDSRRAQDFVQWLMNTKXX

SEQ ID NO: 1871 - protein, 32 aa, Artificial Sequence
  OXM analog
  MOD_RES (2)..(2): Xaa=D-serine
  MOD_RES (31)..(31): Xaa=gamma glutamic acid
  MOD_RES (32)..(32): Xaa=Cys(cholest-5-en-3-yl 1{[(2R)-3-amino-2-(amino)-3-oxopropyl]thio}acetate );
HXQGTFTSDYSKYLDSRAAQDFVQWLMNTKXX

SEQ ID NO: 1872 - protein, 32 aa, Artificial Sequence; identical to SEQ ID NO: 1870
  OXM analog
  MOD_RES (2)..(2): Xaa=D-serine
  MOD_RES (31)..(31): Xaa=gamma glutamic acid
  MOD_RES (32)..(32): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol)

SEQ ID NO: 1873 - protein, 32 aa, Artificial Sequence; identical to SEQ ID NO: 1871
  OXM analog
  MOD_RES (2)..(2): Xaa=D-serine
  MOD_RES (31)..(31): Xaa=gamma glutamic acid
  MOD_RES (32)..(32): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol)

SEQ ID NO: 1874 - protein, 32 aa, Artificial Sequence
  OXM analog
  MOD_RES (2)..(2): Xaa=D-serine
  MOD_RES (31)..(31): Xaa=gamma glutamic acid
  MOD_RES (32)..(32): Xaa=Cys(cholest-5-en-3-yl 1{[(2R)-3-amino-2-(amino)-3-oxopropyl]thio}acetate )
HXQGTFTSDYSKYLDERRAQDFVQWLMNTKXX

SEQ ID NO: 1875 - protein, 32 aa, Artificial Sequence; identical to SEQ ID NO: 1874
  OXM analog
  MOD_RES (2)..(2): Xaa=D-serine
  MOD_RES (31)..(31): Xaa=gamma glutamic acid
  MOD_RES (32)..(32): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol)

SEQ ID NO: 1876 - protein, 33 aa, Artificial Sequence; identical to SEQ ID NO: 1869
  OXM analog
  MOD_RES (2)..(2): Xaa=D-serine
  MOD_RES (31)..(32): Xaa=gamma glutamic acid
  MOD_RES (33)..(33): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol)

SEQ ID NO: 1877 - protein, 33 aa, Artificial Sequence; identical to SEQ ID NO: 1869
  OXM analog
  MOD_RES (2)..(2): Xaa=D-serine
  MOD_RES (31)..(32): Xaa=gamma glutamic acid
  MOD_RES (33)..(33): Xaa=S-{1-[46-(cholest-5-en-3-yloxy)-3,43,46-trioxo -7,10,13,16,19,22,25,28,31,34,37,40-dodecaoxa-4,44 -diazahexatetracont-1-yl]-2,5-dioxopyrrolidin-3-yl }-L-cysteine or Cys (mal-oxa12-cholesterol)

SEQ ID NO: 1878 - protein, 33 aa, Artificial Sequence; identical to SEQ ID NO: 1869
  OXM analog
  MOD_RES (2)..(2): Xaa=Aib
  MOD_RES (31)..(32): Xaa=gamma glutamic acid
  MOD_RES (33)..(33): Xaa== Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol)

SEQ ID NO: 1879 - protein, 33 aa, Artificial Sequence; identical to SEQ ID NO: 1869
  OXM analog
  MOD_RES (2)..(2): Xaa=1-Amino-1-cyclobutane carboxylic acid
  MOD_RES (31)..(32): Xaa=gamma glutamic acid
  MOD_RES (33)..(33): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol)

SEQ ID NO: 1880 - protein, 33 aa, Artificial Sequence
  OXM analog
  MOD_RES (2)..(2): Xaa=D-serine
  MISC_FEATURE (16)..(20): Lactam bridge between side chains
  MOD_RES (31)..(32): Xaa=gamma glutamic acid
  MOD_RES (33)..(33): Xaa=S-[42-(cholest-5-en-3-yloxy)-2,42-dioxo-6,9,12 ,15,18,21,24,27,30,33,36,39-dodecaoxa-3-azadotetra cont-1-yl]-L-cysteine or Cys (oxa12-cholesterol)
HXQGTFTSDYSKYLDERRAKDFVQWLMNTKXXX

SEQ ID NO: 1881 - protein, 33 aa, Artificial Sequence; identical to SEQ ID NO: 1880
  OXM analog
  MOD_RES (2)..(2): Xaa=Aib
  MISC_FEATURE (16)..(20): Lactam bridge between side chains
  MOD_RES (31)..(32): Xaa=gamma glutamic acid
  MOD_RES (33)..(33): Xaa=S-[42-(cholest-5-en-3-yloxy)-2,42-dioxo-6,9,12 ,15,18,21,24,27,30,33,36,39-dodecaoxa-3-azadotetra cont-1-yl]-L-cysteine or Cys (oxa12-cholesterol)

SEQ ID NO: 1882 - protein, 33 aa, Artificial Sequence; identical to SEQ ID NO: 1880
  OXM analog
  MOD_RES (2)..(2): Xaa=1-Amino-1-cyclobutane carboxylic acid
  MISC_FEATURE (16)..(20): Lactam bridge between side chains
  MOD_RES (31)..(32): Xaa=gamma glutamic acid
  MOD_RES (33)..(33): Xaa=S-[42-(cholest-5-en-3-yloxy)-2,42-dioxo-6,9,12 ,15,18,21,24,27,30,33,36,39-dodecaoxa-3-azadotetra cont-1-yl]-L-cysteine or Cys (oxa12-cholesterol)

SEQ ID NO: 1883 - protein, 33 aa, Artificial Sequence; identical to SEQ ID NO: 1869
  OXM analog
  MOD_RES (2)..(2): Xaa=D-serine
  MOD_RES (31)..(32): Xaa=gamma glutamic acid
  MOD_RES (33)..(33): Xaa=S-[42-(cholest-5-en-3-yloxy)-2,42-dioxo-6,9,12 ,15,18,21,24,27,30,33,36,39-dodecaoxa-3-azadotetra cont-1-yl]-L-cysteine or Cys (oxa12-cholesterol)

SEQ ID NO: 1884 - protein, 33 aa, Artificial Sequence; identical to SEQ ID NO: 1869
  OXM analog
  MOD_RES (2)..(2): Xaa=Aib
  MOD_RES (31)..(32): Xaa=gamma glutamic acid
  MOD_RES (33)..(33): Xaa=S-[42-(cholest-5-en-3-yloxy)-2,42-dioxo-6,9,12 ,15,18,21,24,27,30,33,36,39-dodecaoxa-3-azadotetra cont-1-yl]-L-cysteine or Cys (oxa12-cholesterol)

SEQ ID NO: 1885 - protein, 33 aa, Artificial Sequence; identical to SEQ ID NO: 1869
  OXM analog
  MOD_RES (2)..(2): Xaa=1-Amino-1-cyclobutane carboxylic acid
  MOD_RES (31)..(32): Xaa=gamma glutamic acid
  MOD_RES (33)..(33): Xaa=S-[42-(cholest-5-en-3-yloxy)-2,42-dioxo-6,9,12 ,15,18,21,24,27,30,33,36,39-dodecaoxa-3-azadotetra cont-1-yl]-L-cysteine or Cys (oxa12-cholesterol)

SEQ ID NO: 1886 - protein, 33 aa, Artificial Sequence; identical to SEQ ID NO: 1869
  OXM analog
  MOD_RES (2)..(2): Xaa=D-serine
  MOD_RES (31)..(32): Xaa=gamma glutamic acid
  MOD_RES (33)..(33): Xaa=Lys(gamma-glutamic acid-palmitoyl)
  MOD_RES (33)..(33): C-terminal amidation

SEQ ID NO: 1887 - protein, 33 aa, Artificial Sequence
  OXM analog
  MOD_RES (2)..(2): Xaa=D-serine
  MOD_RES (31)..(32): Xaa=gamma glutamic acid
  MOD_RES (33)..(33): Xaa=S-[42-(cholest-5-en-3-yloxy)-2,42-dioxo-6,9,12 ,15,18,21,24,27,30,33,36,39-dodecaoxa-3-azadotetra cont-1-yl]-L-cysteine or Cys (oxa12-cholesterol)
  MOD_RES (33)..(33): C-terminal amidation
HXQGTFTSDYSKYLDERRAQDFVQWLMNTKXXX

SEQ ID NO: 1888 - protein, 32 aa, Artificial Sequence
  OXM analog
  MOD_RES (2)..(2): Xaa=D-serine
  MOD_RES (20)..(20): Xaa=Lys(gamma-glutamic acid-palmitoyl)
  MOD_RES (31)..(32): Xaa=gamma glutamic acid
  MOD_RES (32)..(32): C-terminal amidation
HXQGTFTSDYSKYLDSRRAXDFVQWLMNTKXX

SEQ ID NO: 1889 - protein, 31 aa, Artificial Sequence
  OXM analog
  MOD_RES (2)..(2): Xaa=D-serine
  MOD_RES (20)..(20): Xaa=Lys(gamma-glutamic acid-gamma-glutamic acid-palmitoyl)
  MOD_RES (31)..(31): Xaa=gamma glutamic acid
  MOD_RES (31)..(31): C-terminal amidation
HXQGTFTSDYSKYLDSRRAXDFVQWLMNTKX

SEQ ID NO: 1890 - protein, 30 aa, Artificial Sequence
  OXM analog
  MOD_RES (2)..(2): Xaa=D-serine
  MOD_RES (10)..(10): Xaa=Lys(gamma-glutamic acid-gamma-glutamic acid-palmitoyl)
  MOD_RES (30)..(30): C-terminal amidation
HXQGTFTSDXSKYLDSRRAQDFVQWLMNTK

SEQ ID NO: 1891 - protein, 30 aa, Artificial Sequence
  OXM analog
  MOD_RES (2)..(2): Xaa=D-serine
  MOD_RES (20)..(20): Xaa=Lys(gamma-glutamic acid-gamma-glutamic acid-palmitoyl)
  MOD_RES (30)..(30): C-terminal amidation
HXQGTFTSDYSKYLDERRAXDFVQWLMNTK

SEQ ID NO: 1892 - protein, 30 aa, Artificial Sequence
  OXM analog
  MOD_RES (2)..(2): Xaa=D-serine
  MOD_RES (10)..(10): Xaa=Lys(gamma-glutamic acid-gamma-glutamic acid-palmitoyl)
  MOD_RES (30)..(30): C-terminal amidation
HXQGTFTSDXSKYLDERRAQDFVQWLMNTK

SEQ ID NO: 1893 - protein, 33 aa, Artificial Sequence; identical to SEQ ID NO: 1869
  OXM analog
  MOD_RES (2)..(2): Xaa=D-serine
  MOD_RES (31)..(32): Xaa=gamma glutamic acid
  MOD_RES (33)..(33): Xaa=S-[78-(cholest-5-en-3-yloxy)-2,78-dioxo-6,9,12 ,15,18,21,24,27,30,33,36,39,42,45,48,51,54,57,60,6 3,66,69,72,75-tetracosaoxa-3-azaoctaheptacont-1-yl ]-L-cysteine or Cys (oxa24-cholesterol)

SEQ ID NO: 1894 - protein, 33 aa, Artificial Sequence
  OXM analog
  MOD_RES (2)..(2): Xaa=Aib
  MOD_RES (24)..(24): Xaa=Lys(DOTA)
  MOD_RES (27)..(27): Xaa=methionine sulfoxide
  MOD_RES (31)..(32): Xaa=gamma glutamic acid
  MOD_RES (33)..(33): Xaa=S-[42-(cholest-5-en-3-yloxy)-2,42-dioxo-6,9,12 ,15,18,21,24,27,30,33,36,39-dodecaoxa-3-azadotetra cont-1-yl]-L-cysteine or Cys (oxa12-cholesterol)
  MOD_RES (33)..(33): C-terminal amidation
HXDGTFTSDYSKYLDSRRAQDFVXWLXNTKXXX

SEQ ID NO: 1895 - protein, 31 aa, Artificial Sequence
  OXM analog
  MOD_RES (2)..(2): Xaa=D-serine
  MOD_RES (10)..(10): Xaa=Lys(gamma glutamic acid-palmitoyl)
  MOD_RES (31)..(31): Xaa=gamma glutamic acid
  MOD_RES (31)..(31): C-terminal amidation
HXQGTFTSDXSKYLDERRAQDFVQWLMNTKX

SEQ ID NO: 1896 - protein, 32 aa, Artificial Sequence
  OXM analog
  MOD_RES (2)..(2): Xaa=D-serine
  MOD_RES (10)..(10): Xaa=Lys(palmitoyl)
  MOD_RES (31)..(32): Xaa=gamma glutamic acid
  MOD_RES (32)..(32): C-terminal amidation
HXQGTFTSDXSKYLDERRAQDFVQWLMNTKXX

SEQ ID NO: 1897 - protein, 30 aa, Artificial Sequence; identical to SEQ ID NO: 1892
  OXM analog
  MOD_RES (2)..(2): Xaa=aib
  MOD_RES (10)..(10): Xaa=Lys(gamma-glutamic acid-gamma glutamic acid-palmitoyl)
  MOD_RES (30)..(30): C-terminal amidation

SEQ ID NO: 1898 - protein, 30 aa, Artificial Sequence; identical to SEQ ID NO: 1892
  OXM analog
  MOD_RES (2)..(2): Xaa=acb
  MOD_RES (10)..(10): Xaa=Lys(gamma-glutamic acid-gamma-glutamic acid-palmitoyl
  MOD_RES (30)..(30): C-terminal amidation

SEQ ID NO: 1899 - protein, 31 aa, Artificial Sequence; identical to SEQ ID NO: 1895
  OXM analog
  MOD_RES (2)..(2): Xaa=D-Serine
  MOD_RES (10)..(10): Xaa=Lys(gamma-glutamic acid-gamma-glutamic acid-palmitoyl
  MOD_RES (16)..(16): Xaa=aib
  MOD_RES (31)..(31): Xaa=gamma glutamic acid
  MOD_RES (31)..(31): C-terminal amidation

SEQ ID NO: 1900 - protein, 33 aa, Artificial Sequence; identical to SEQ ID NO: 1869
  OXM analog
  MOD_RES (2)..(2): Xaa=aib
  MOD_RES (31)..(32): Xaa=gamma glutamic acid
  MOD_RES (33)..(33): Xaa=Lys(gamma glutamic acid-palmitoyl)
  MOD_RES (33)..(33): C-terminal amidation

SEQ ID NO: 1901 - protein, 33 aa, Artificial Sequence; identical to SEQ ID NO: 1869
  OXM analog
  MOD_RES (2)..(2): Xaa=acb
  MOD_RES (31)..(32): Xaa=gamma glutamic acid
  MOD_RES (33)..(33): Xaa=Lys(gamma glutamic acid-palmitoyl)
  MOD_RES (33)..(33): C-terminal amidation

SEQ ID NO: 1902 - protein, 33 aa, Artificial Sequence; identical to SEQ ID NO: 1869
  OXM analog
  MOD_RES (2)..(2): Xaa=D-serine
  MOD_RES (31)..(32): Xaa=gamma glutamic acid
  MOD_RES (33)..(33): Xaa=S-[38-(cholest-5-en-3-yloxy)-2-oxo-6,9,12,15,1 8,21,24,27,30,33,36-undecaoxa-3-azaoctatriacont-1- yl]-L-cysteine or Cys (oxa12-O-cholesterol)

SEQ ID NO: 1903 - protein, 30 aa, Artificial Sequence
  OXM analog
  VARIANT (2)..(2): Xaa=D-serine or Aib;
  VARIANT (17)..(17): Xaa=Arg or Glu
  VARIANT (18)..(18): Xaa=Arg or Ala
  VARIANT (27)..(27): Xaa=methionine, norleucine, or O-methyl-L-homoserine
HXQGTFTSDYSKYLDSXXAQDFVQWLXNTK

SEQ ID NO: 1904 - protein, 7 aa, Artificial Sequence
  OXM peptide
RNRNNIA

SEQ ID NO: 1905 - protein, 37 aa, Artificial Sequence
  OXM analog
  VARIANT (2)..(2): Xaa=D-serine; Aib; Acb; 1-Amino-1-cyclohexane carboxylic acid (Acx); alpha-aminobutyric acid(Abu); D- alpha-aminobutyric acid (D-Abu); Aminovaleric acid Nva); beta-cyclopropyl-alanine (Cpa); propargylglycine (Prg); Allylglycine (Alg);
  VARIANT (17)..(17): Xaa=Arg or Glu
  VARIANT (18)..(18): Xaa=Arg or Ala
  VARIANT (27)..(27): Xaa=methionine (M), norleucine (Nle), methionine sulfoxide (m) or O-methyl-L-homoserine (o)
HXQGTFTSDYSKYLDSXXAQDFVQWLXNTKRNRNNIA

SEQ ID NO: 1906 - protein, 37 aa, Artificial Sequence
  OXM analog
  VARIANT (2)..(2): Xaa = D-Ser,  Aib,  Acb, Acx,  Abu, D-Abu, Aminovaleric acid (Nva), Cpa, Prg, Alg, 2-Cha, D-tbg, Vg, Acp, or Acpe
  VARIANT (12)..(12): Xaa=Ser or Lys
  VARIANT (16)..(16): Xaa=Ser or Glu
  VARIANT (17)..(17): Xaa=Arg or Glu
  VARIANT (18)..(18): Xaa=Arg or Ala
  VARIANT (20)..(20): Xaa=Gln or Lys
  VARIANT (27)..(27): Xaa=a methionine, norleucine, methionine sulfoxide, or O-methyl-L-homoserine
HXQGTFTSDYSXYLDXXXAXDFVQWLXNTKRNRNNIA

SEQ ID NO: 1907 - protein, 31 aa, Artificial Sequence
  OXM analog
  VARIANT (2)..(2): Xaa = D-Ser,  Aib,  Acb, Acx,  Abu, D-Abu, Aminovaleric acid (Nva), Cpa, Prg, Alg, 2-Cha, D-tbg, Vg, Acp, or Acpe
  VARIANT (10)..(10): Xaa=Tyr or Lys
  VARIANT (12)..(12): Xaa=Ser or Lys
  VARIANT (16)..(16): Xaa=Ser or Glu
  VARIANT (17)..(17): Xaa=Arg or Glu
  VARIANT (18)..(18): Xaa=Arg or Ala
  VARIANT (20)..(20): Xaa=Gln or Lys
  VARIANT (27)..(27): Xaa=methionine, norleucine, methionine sulfoxide, or O-methyl-L-homoserine
  VARIANT (31)..(31): Xaa=optional, but when present is one or more gamma glutamic acid residues
HXQGTFTSDXSXYLDXXXAXDFVQWLXNTKX

SEQ ID NO: 1908 - protein, 31 aa, Artificial Sequence; identical to SEQ ID NO: 1907
  OXM analog
  MOD_RES (2)..(2): Xaa = D-Ser,  Aib,  Acb, Acx,  Abu, D-Abu, Aminovaleric acid (Nva), Cpa, Prg, Alg, 2-Cha, D-tbg, Vg, Acp, or Acpe
  MOD_RES (10)..(10): Xaa=Tyr or Lys
  MOD_RES (12)..(12): Xaa=Ser or Lys
  MOD_RES (16)..(16): Xaa=Ser or Lys
  MOD_RES (17)..(17): Xaa=Arg or Glu
  MOD_RES (18)..(18): Xaa=Arg or Ala
  MOD_RES (20)..(20): Xaa=Gln or Lys
  MOD_RES (27)..(27): Xaa=methionine, norleucine, methionine sulfoxide, or O-methyl-L-homoserine
  MOD_RES (31)..(31): optional, but when present one or more gamma glutamic acid residues

SEQ ID NO: 1909 - protein, 30 aa, Artificial Sequence
  OXM analog
HSQGTFTSDSSKYLDSRRAQDFVQWLMNTK

SEQ ID NO: 1910 - protein, 32 aa, Artificial Sequence
  OXM analog
  MOD_RES (2)..(2): Xaa=D-serine, Aib, Acb, Acx, Abu, D-Abu,  Aminovaleric acid (Nva), Cpa, Prg, Alg, 2-Cha, D-tbg, Vg, Acp, or Acpe
  MOD_RES (10)..(10): Xaa=Tyr or Lys
  MOD_RES (12)..(12): Xaa=Ser or Lys
  MOD_RES (16)..(16): Xaa=Ser, aib,  or Glu
  MOD_RES (17)..(17): Xaa=Arg or Glu
  MOD_RES (18)..(18): Xaa=Arg or Ala
  MOD_RES (20)..(20): Xaa=Glu or Lys
  MOD_RES (27)..(27): Xaa=Met, norleucine, methionine sulfoxide, or O-methyl-L-homoserine
  MOD_RES (31)..(31): Xaa=gamma-glutamic acid
  MOD_RES (32)..(32): Xaa=is optional but when present, it is gamma-glutamic acid
HXQGTFTSDXSXYLDXXXAXDFVQWLXNTKXX

SEQ ID NO: 1911 - protein, 31 aa, Artificial Sequence
  OXM analog
  MOD_RES (2)..(2): Xaa=D-serine
  MOD_RES (10)..(10): Xaa=Lys(gamma-glutamic acid-gamma-glutamic acid-palmitoyl)
  MOD_RES (16)..(16): Xaa=Aib
  MOD_RES (31)..(31): Xaa=gamma-glutamic acid
  MOD_RES (31)..(31): C-terminal amidation
HXQGTFTSDXSKYLDXRRAQDFVQWLMNTEX

SEQ ID NO: 1912 - protein, 31 aa, Artificial Sequence
  OXM analog
  MOD_RES (2)..(2): Xaa=D-serine
  MOD_RES (10)..(10): Xaa=Lys(gamma-glutamic acid-gamma-glutamic acid-palmitoyl)
  MOD_RES (16)..(16): Xaa=aib
  MOD_RES (30)..(30): Xaa=D-Lys
  MOD_RES (31)..(31): Xaa=gamma-glutamic acid
  MOD_RES (31)..(31): C-terminal amidation
HXQGTFTSDXSKYLDXRRAQDFVQWLMNTXX

SEQ ID NO: 1913 - protein, 31 aa, Artificial Sequence; identical to SEQ ID NO: 1895
  OXM analog
  MOD_RES (2)..(2): Xaa=D-serine
  MOD_RES (10)..(10): Xaa=Lys(gamma-glutamic acid-gamma-glutamic acid-palmitoyl)
  MOD_RES (31)..(31): Xaa=gamma-glutamic acid
  MOD_RES (31)..(31): C-terminal amidation

SEQ ID NO: 1914 - protein, 31 aa, Artificial Sequence; identical to SEQ ID NO: 1911
  OXM analog
  MOD_RES (2)..(2): Xaa=D-serine
  MOD_RES (10)..(10): Xaa=Lys(gamma-glutamic acid-gamma-glutamic acid-palmitoyl)
  MOD_RES (16)..(16): Xaa=aib
  MOD_RES (31)..(31): Xaa=gamma-D-glutamic acid

SEQ ID NO: 1915 - protein, 31 aa, Artificial Sequence; identical to SEQ ID NO: 1895
  OXM analog
  MOD_RES (2)..(2): Xaa=D-serine
  MOD_RES (10)..(10): Xaa=Lys(glutamic acid-glutamic acid-palmitoyl)
  MOD_RES (31)..(31): Xaa=gamma-glutamic acid
  MOD_RES (31)..(31): C-terminal amidation

SEQ ID NO: 1916 - protein, 31 aa, Artificial Sequence; identical to SEQ ID NO: 1895
  OXM analog
  MOD_RES (2)..(2): Xaa=D-serine
  MOD_RES (10)..(10): Xaa=Lys(Arg-Arg-palmitoyl)
  MOD_RES (31)..(31): Xaa=gamma-glutamic acid
  MOD_RES (31)..(31): C-terminal amidation

SEQ ID NO: 1917 - protein, 31 aa, Artificial Sequence; identical to SEQ ID NO: 1895
  OXM analog
  MOD_RES (2)..(2): Xaa=D-Serine
  MOD_RES (10)..(10): Xaa=Lys(homocysteic acid-homocysteic acid-palmitoyl)
  MOD_RES (31)..(31): Xaa=gamma-glutamic acid
  MOD_RES (31)..(31): C-terminal amidation

SEQ ID NO: 1918 - protein, 31 aa, Artificial Sequence; identical to SEQ ID NO: 1895
  OXM analog
  MOD_RES (2)..(2): Xaa=D-Serine
  MOD_RES (10)..(10): Xaa=Lys(D-glutamic acid-D-glutamic acid-palmitoyl)
  MOD_RES (31)..(31): Xaa=gamma-glutamic acid
  MOD_RES (31)..(31): C-terminal amidation

SEQ ID NO: 1919 - protein, 31 aa, Artificial Sequence
  OXM analog
  MOD_RES (2)..(2): Xaa=D-Serine
  MOD_RES (10)..(10): Xaa=Lys(gamma-glutamic acid-gamma-glutamic acid-myristoyl)
  MOD_RES (16)..(16): Xaa=aib
  MOD_RES (31)..(31): Xaa=gamma-glutamic acid
  MOD_RES (31)..(31): C-terminal amidation
HXQGTFTSDXSKYLDXRRAQDFVQWLMNTKX

SEQ ID NO: 1920 - protein, 31 aa, Artificial Sequence
  OXM analog
  MOD_RES (2)..(2): Xaa=D-Serine
  MOD_RES (10)..(10): Xaa=Lys(gamma-glutamic acid-gamma-glutamic acid-palmitoyl)
  MOD_RES (16)..(16): Xaa=aib
  MOD_RES (31)..(31): Xaa=gamma-glutamic acid
  MOD_RES (31)..(31): C-terminal amidation
HXQGTFTSDXSKYLDXRAAQDFVQWLMDTKX

SEQ ID NO: 1921 - protein, 31 aa, Artificial Sequence; identical to SEQ ID NO: 1919
  OXM analog
  MOD_RES (2)..(2): Xaa=D-Serine
  MOD_RES (10)..(10): Xaa=Lys(gamma-glutamic acid-gamma-glutamic acid-stearoyl)
  MOD_RES (16)..(16): Xaa=aib
  MOD_RES (31)..(31): Xaa=gamma-glutamic acid
  MOD_RES (31)..(31): C-terminal amidation

SEQ ID NO: 1922 - protein, 29 aa, Homo sapiens
SSSSKAPPPSLPSPSRLPGPSDTPILPQR

SEQ ID NO: 1923 - protein, 29 aa, Homo sapiens
SSSSRAPPPSLPSPSRLPGPSDTPILPQK

SEQ ID NO: 1924 - protein, 29 aa, Homo sapiens
  MISC_FEATURE (5)..(5): Xaa at position 5 is lysine or Arginine
  MISC_FEATURE (29)..(29): Xaa at position 29 is lysine or Arginine
SSSSXAPPPSLPSPSRLPGPSDTPILPQX

SEQ ID NO: 1925 - protein, 8 aa, Homo sapiens
GAGSSSRR

SEQ ID NO: 1926 - protein, 29 aa, Artificial Sequence
  glucagon analogue
  MISC_FEATURE (1)..(1): Xaa at position 1 = His, D-histidine, desaminohistidine, hydroxyl-histidine, acetyl-histidine, homo-histidine or alpha, alpha-dimethyl imidiazole acetic acid (DMIA), N-methyl histidine, alpha-methyl histidine, or imidazole acetic acid
  MISC_FEATURE (2)..(2): Xaa at position 2 = Ser, D-serine, Ala, D-alanine, Val, glycine, n-methyl serine, aminoisobutyric acid (AIB) or N-methyl alanine
  MISC_FEATURE (3)..(3): Xaa at position 3 is Gln, Glu, Orn or  Nle
  MISC_FEATURE (10)..(10): Xaa at position 10 = Tyr, Val or Trp
  MISC_FEATURE (12)..(12): Xaa at position 12 = Ser, Lys or Arg
  MISC_FEATURE (15)..(15): Xaa at position 15 = Asp, Glu, cysteic acid, homoglutamic acid and homocysteic acid
  MISC_FEATURE (16)..(16): Xaa at position 16 = Ser, Gly, Glu, Gln, homoglutamic acid or homocysteic acid
  MISC_FEATURE (17)..(17): Xaa at position 17 = Arg, Gln, Lys, Cys, Orn, homocycstein or acetyl phenylalanine
  MISC_FEATURE (18)..(18): Xaa at position 18 = Arg, Ala,Lys, Cys, Orn, homocycstein or acetyl phenylalanine
  MISC_FEATURE (20)..(20): Xaa at position 20 = Gln, Lys, arginine, ornithine or citrulline
  MISC_FEATURE (21)..(21): Xaa at position 21 = Gln, Glu, Asp, Lys, Cys, Orn, homocycstein or acetyl phenyalanine
  MISC_FEATURE (23)..(23): Xaa at position 23 is Val or Ile
  MISC_FEATURE (24)..(24): Xaa at position 24 = Ala, Gln, Glu, Lys, Cys, Orn, homocycstein or acetyl phenyalanine
  MISC_FEATURE (27)..(27): Xaa at position 27 = Met, Leu, Val or Nle
  MISC_FEATURE (28)..(28): Xaa at position 28 = Asn, Lys or Asp
  MISC_FEATURE (29)..(29): Xaa at position 29 is Thr, Gly, Lys, Cys, Orn, homocycstein or acetyl phenyalanine
XXXGTFTSDXSXYLXXXXAXXFXXWLXXX

SEQ ID NO: 1927 - protein, 41 aa, Homo sapiens
  MISC_FEATURE (2)..(2): Xaa at position 2 is aminoisobutyric acid
  MISC_FEATURE (40)..(40): Xaa at position 40 is  lysine acylated with a C16 acyl group via a gamma glutamic acid linker
HXEGTFTSDVSSYLEEQAAKEFIAWLVKGGPSSGAPPPSXC

SEQ ID NO: 1928 - protein, 29 aa, Artificial Sequence
  glucagon analogue
  MISC_FEATURE (1)..(1): Xaa at position 1 = His, D-histidine, desaminohistidine, hydroxyl-histidine, acetyl-histidine, homo-histidine or alpha, alpha-dimethyl imidiazole acetic acid (DMIA), N-methyl histidine, alpha-methyl histidine, or imidazole acetic acid
  MISC_FEATURE (2)..(2): Xaa at position 2 = Ser, D-serine, Ala, D-alanine, Val, glycine, n-methyl serine, aminoisobutyric acid (AIB) or N-methyl alanine
  MISC_FEATURE (3)..(3): Xaa at position 3 is Gln or Glu
  MISC_FEATURE (10)..(10): Xaa at position 10 is an amino acid, for example Lys, covalently attached to a C12 to C18 acyl or alkyl group
  MISC_FEATURE (12)..(12): Xaa at position 12 = Ile, or Lys
  MISC_FEATURE (15)..(15): Xaa at position 15 = Asp, or Glu
  MISC_FEATURE (16)..(16): Xaa at position 16 = Ser, Lys, Arg, or Glu
  MISC_FEATURE (17)..(17): Xaa at position 17 = Arg, or Gln
  MISC_FEATURE (18)..(18): Xaa at position 18 = Arg, or Ala
  MISC_FEATURE (20)..(20): Xaa at position 20 = Gln, Aib or Lys
  MISC_FEATURE (21)..(21): Xaa at position 21 = Glu, or Asp
  MISC_FEATURE (23)..(23): Xaa at position 23 is Val or Ile
  MISC_FEATURE (24)..(24): Xaa at position 24 = Ala, Gln, or Asn
  MISC_FEATURE (27)..(27): Xaa at position 27 = Met, Leu, or Val
  MISC_FEATURE (28)..(28): Xaa at position 28 = Ala, Asn, Lys or Asp
  MISC_FEATURE (29)..(29): Xaa at position 29 is Thr, or Gly
XXXGTFTSDXSXYLXXXXAXXFXXWLXXX

SEQ ID NO: 1929 - protein, 31 aa, Artificial Sequence
  glucagon analogue
  MISC_FEATURE (1)..(1): Xaa at position 1 = His, D-histidine, desaminohistidine, hydroxyl-histidine, acetyl-histidine, homo-histidine or alpha, alpha-dimethyl imidiazole acetic acid (DMIA), N-methyl histidine, alpha-methyl histidine, or imidazole acetic acid
  MISC_FEATURE (2)..(2): Xaa at position 2 = aminoisobutyric acid (AIB)
  MISC_FEATURE (3)..(3): Xaa at position 3 is  Glu, Ala, Leu, Ile, Nle, Val, NorVal, homoserine, Met, methionine sulfoxide, methionine sulfone, acetyl-Orn, acetyl-diaminobutanoic acid, or acetyl-Lys
  MISC_FEATURE (10)..(10): Xaa at position 10 is an amino acid, for example Lys, covalently attached to a C12 to C18 acyl or alkyl group
  MISC_FEATURE (15)..(15): Xaa at position 15 = Asp, or Glu
  MISC_FEATURE (16)..(16): Xaa at position 16 = Ser, His, Aib, Ala, Lys, or Glu
  MISC_FEATURE (17)..(17): Xaa at position 17 = Arg, His or Gln
  MISC_FEATURE (20)..(20): Xaa at position 20 = Gln, Ala, His, Aib or Lys
  MISC_FEATURE (21)..(21): Xaa at position 21 = Glu, or Asp
  MISC_FEATURE (27)..(27): Xaa at position 27 = Nle, Leu, or Ala
  MISC_FEATURE (28)..(28): Xaa at position 28 = Ala, Lys, Asp or Glu
  MISC_FEATURE (29)..(29): Xaa at position 29 is Ala, Aib, Val or Gly
  MISC_FEATURE (30)..(30): Xaa at position 30 is Ala or Gly
  MISC_FEATURE (31)..(31): Xaa at position 31is Ala, Arg or Lys
XXXGTFTSDXSKYLXXXAAXXFVQWLXXXXX

SEQ ID NO: 1930 - protein, 39 aa, Artificial Sequence; identical to SEQ ID NO: 757
  glucagon analogue
  MISC_FEATURE (2)..(2): Xaa at position 2 = aminoisobutyric acid (AIB)
  MISC_FEATURE (20)..(20): Xaa at position 20 = aminoisobutyric acid (AIB)

SEQ ID NO: 1931 - protein, 39 aa, Artificial Sequence
  glucagon analogue
  MISC_FEATURE (2)..(2): Xaa at position 2 = aminoisobutyric acid (AIB)
HXQGTFTSDYSKYLDERAAQDFVQWLLDGGPSSGAPPPS

SEQ ID NO: 1932 - protein, 39 aa, Artificial Sequence
  glucagon analogue
  MISC_FEATURE (2)..(2): Xaa at position 2 = aminoisobutyric acid (AIB)
HXEGTFTSDVSSYLEEQAAKEFIAWLVKGGPSSGAPPPS

SEQ ID NO: 1933 - protein, 40 aa, Artificial Sequence
  glucagon analogue
HSQGTFTSDYSKYLDSRRAQDFVQWLMNTGGPSSGAPPPS

SEQ ID NO: 1934 - protein, 39 aa, Artificial Sequence
  glucagon analogue
  MISC_FEATURE (2)..(2): Xaa at position 2 = aminoisobutyric acid (AIB)
  MISC_FEATURE (20)..(20): Xaa at position 20 = aminoisobutyric acid (AIB)
  MISC_FEATURE (39)..(39): C-terminal amide
YXEGTFISDYSIYLDRQAAXEFVNWLLAGGPSSGAPPPS

SEQ ID NO: 1935 - protein, 14 aa, Artificial Sequence
  Synthetic peptide
  MISC_FEATURE: Peptide fragment representing carboxy terminal 10 amino acids of Exendin-4 plus a C-terminal extension including a Lys at position 13 acylated with a C16 group
GGPSSGAPPPSCKC

SEQ ID NO: 1936 - protein, 28 aa, Artificial Sequence
  Synthetic peptide
  MOD_RES (1)..(1): Xaa is His, D-histidine, desaminohistidine, hydroxyl-histidine, acetyl-histidine, homo-histidine or alpha, alpha-dimethyl imidiazole acetic acid (DMIA) N-methyl histidine, alpha-methyl histidine, or imidazole acetic acid
  MOD_RES (2)..(2): Xaa is Ser, D-serine, Ala, Val, glycine, N-methyl serine or aminoisobutyric acid (AIB), N-methyl alanine or D-alanine
  MOD_RES (10)..(10): Xaa is valine, tyrosine or Lys acylated with C16 acyl group (K(rEC16)C)
XXEGTFTSDXSSYLEEQAAKEFIAWLVK

SEQ ID NO: 1937 - protein, 28 aa, Artificial Sequence
  Synthetic peptide
  MOD_RES (1)..(1): Xaa is His, D-histidine, desaminohistidine, hydroxyl-histidine, acetyl-histidine, homo-histidine or alpha, alpha-dimethyl imidiazole acetic acid (DMIA) N-methyl histidine, alpha-methyl histidine, or imidazole acetic acid
  MOD_RES (2)..(2): Xaa is Ser, D-serine, Ala, Val, glycine, N-methyl serine or aminoisobutyric acid (AIB), N-methyl alanine or D-alanine
  MOD_RES (18)..(18): Xaa is Ala or Arg
  MOD_RES (24)..(24): Xaa is Ala, Gln or Cys-PEG
XXQGTFTSDYSKYLDERXAKDFVXWLMN

SEQ ID NO: 1938 - protein, 39 aa, Homo sapiens; identical to SEQ ID NO: 521
  MOD_RES (29)..(29): C-terminal amidation

SEQ ID NO: 1939 - protein, 41 aa, Artificial Sequence; identical to SEQ ID NO: 1927
  Glucagon analogue
  MISC_FEATURE (2)..(2): Xaa is d-serine, alanine, glycine, n-methyl serine and aminoisobutyric acid
  MOD_RES (40)..(40): Xaa at 40 is a Lys acylated with C16 acyl group

SEQ ID NO: 1940 - protein, 39 aa, Artificial Sequence; identical to SEQ ID NO: 1932
  Glucagon analogue
  misc_feature (2)..(2): Xaa is amino isobutyric acid

SEQ ID NO: 1941 - protein, 38 aa, Artificial Sequence
  Glucagon analogue
HSQTFTSDYSKYLDSRRAQDFVQWLMTGGPSSGAPPPS

SEQ ID NO: 1942 - protein, 39 aa, Artificial Sequence; identical to SEQ ID NO: 1932
  glucagon analogue
  MISC_FEATURE (2)..(2): Xaa at position 2 is amino isobutyric acid

SEQ ID NO: 1943 - protein, 41 aa, Artificial Sequence
  glucagon analogue
  misc_feature (2)..(2): Xaa at position 2 is amino isobutyric acid
HXEGTFTSDVSSYLEEQAAKEFIAWLVKGGPSSGAPPPSKG

SEQ ID NO: 1944 - protein, 41 aa, Artificial Sequence; identical to SEQ ID NO: 1943
  glucagon analogue
  misc_feature (2)..(2): Xaa at position 2 is amino isobutyric acid

SEQ ID NO: 1945 - protein, 38 aa, Artificial Sequence
  glucagon analogue
  misc_feature (1)..(1): Xaa at position 2 is amino isobutyric acid
XEGTFTSDVSSYLEEQAAKEFIAWLVKGGPSSGAPPPS

SEQ ID NO: 1946 - protein, 39 aa, Artificial Sequence
  glucagon analogue
  misc_feature (2)..(2): Xaa at position 2 is amino isobutyric acid
HXEGTFTSDVSSYLEEQAAREFIAWLVRGGPSSGAPPPS

SEQ ID NO: 1947 - protein, 39 aa, Artificial Sequence; identical to SEQ ID NO: 1932
  glucagon analogue
  misc_feature (2)..(2): Xaa at position 2 is amino isobutyric acid

SEQ ID NO: 1948 - protein, 38 aa, Artificial Sequence
  glucagon analogue
HSQTFTSDYSKYLDSRRAQDFVQWLMNTGPSSGAPPPS

SEQ ID NO: 1949 - protein, 38 aa, Artificial Sequence
  glucagon analogue
  misc_feature (2)..(2): Xaa at position 2 is amino isobutyric acid
HXQTFTSDYSKYLDSRRAQDFVQWLMNTGPSSGAPPPS

SEQ ID NO: 1950 - protein, 38 aa, Artificial Sequence
  glucagon analogue
SQGTFTSDYSKYLDSRRAQDFVQWLMNTGPSSGAPPPS

SEQ ID NO: 1951 - protein, 39 aa, Artificial Sequence; identical to SEQ ID NO: 1932
  glucagon analogue
  misc_feature (2)..(2): Xaa at position 2 is amino isobutyric acid

SEQ ID NO: 1952 - protein, 39 aa, Artificial Sequence; identical to SEQ ID NO: 757
  glucagon analogue
  misc_feature (2)..(2): Xaa at position 2 is amino isobutyric acid
  misc_feature (20)..(20): Xaa at position 20 is amino isobutyric acid

SEQ ID NO: 1953 - protein, 40 aa, Artificial Sequence
  glucagon analogue
  misc_feature (2)..(2): Xaa at position 2 is amino isobutyric acid
  misc_feature (10)..(10): Lys acylated with a C16 fatty acyl group via gamma-Glu spacer
HXEGTFTSDKSSYLEEQAAKEFIAWLVKGGPSSGAPPPSG

SEQ ID NO: 1954 - protein, 41 aa, Artificial Sequence
  glucagon analogue
  misc_feature (2)..(2): Xaa at position 2 is amino isobutyric acid
  misc_feature (41)..(41): Lys acylated with a C16 fatty acyl group via gamma-Glu spacer
HXEGTFTSDVSSYLEEQAAKEFIAWLVKGGPSSGAPPPSGK

SEQ ID NO: 1955 - protein, 39 aa, Artificial Sequence; identical to SEQ ID NO: 1932
  glucagon analogue
  misc_feature (2)..(2): Xaa at position 2 is amino isobutyric acid

SEQ ID NO: 1956 - protein, 29 aa, Artificial Sequence
  glucagon analogue
  misc_feature (2)..(2): Xaa at position 2 is amino isobutyric acid
HXEGTFTSDVSSYLEEQAAKEFIAWLVKG

SEQ ID NO: 1957 - protein, 39 aa, Artificial Sequence
  glucagon analogue
  misc_feature (1)..(1): Xaa at position 1 is amino isobutyric acid
  misc_feature (39)..(39): Lys acylated with a C16 fatty acyl group via gamma-Glu spacer
XEGTFTSDVSSYLEEQAAKEFIAWLVKGGPSSGAPPPSK

SEQ ID NO: 1958 - protein, 40 aa, Artificial Sequence; identical to SEQ ID NO: 1953
  glucagon analogue
  misc_feature (2)..(2): Xaa at position 2 is amino isobutyric acid
  misc_feature (10)..(10): Lys acylated with a C16 fatty acyl group via gamma-Glu spacer

SEQ ID NO: 1959 - protein, 40 aa, Artificial Sequence; identical to SEQ ID NO: 744
  glucagon analogue
  misc_feature (2)..(2): Xaa at position 2 is amino isobutyric acid
  misc_feature (40)..(40): Lys acylated with a C16 fatty acyl group via gamma-Glu spacer

SEQ ID NO: 1960 - protein, 39 aa, Artificial Sequence; identical to SEQ ID NO: 1946
  glucagon analogue
  misc_feature (2)..(2): Xaa at position 2 is amino isobutyric acid

SEQ ID NO: 1961 - protein, 40 aa, Artificial Sequence
  glucagon analogue
  misc_feature (2)..(2): Xaa at position 2 is amino isobutyric acid
HXEGTFTSDVSSYLEEQAAREFIAWLVRGGPSSGAPPPSK

SEQ ID NO: 1962 - protein, 39 aa, Artificial Sequence
  glucagon analogue
  misc_feature (2)..(2): Xaa at position 2 is amino isobutyric acid
  misc_feature (39)..(39): Lys pegylated with 20K PEG
HXEGTFTSDVSSYLEEQAAREFIAWLVRGPSSGAPPPSK

SEQ ID NO: 1963 - protein, 40 aa, Artificial Sequence; identical to SEQ ID NO: 744
  glucagon analogue
  misc_feature (2)..(2): Xaa at position 2 is amino isobutyric acid
  misc_feature (40)..(40): Lys acylated with a C16 fatty acyl group via gamma-Glu spacer

SEQ ID NO: 1964 - protein, 42 aa, Artificial Sequence
  glucagon analogue
  misc_feature (2)..(2): Xaa at position 2 is amino isobutyric acid
YXEGTFISDYSIAMDKIHQQDFVNWLLAQKGKKNDWKHNITQ

SEQ ID NO: 1965 - protein, 40 aa, Artificial Sequence; identical to SEQ ID NO: 1961
  glucagon analogue
  misc_feature (2)..(2): Xaa at position 2 is amino isobutyric acid
  misc_feature (40)..(40): Lys pegylated with 10K PEG

SEQ ID NO: 1966 - protein, 40 aa, Artificial Sequence; identical to SEQ ID NO: 1961
  glucagon analogue
  misc_feature (2)..(2): Xaa at position 2 is amino isobutyric acid
  misc_feature (40)..(40): Lsy pegylated with 20K PEG

SEQ ID NO: 1967 - protein, 47 aa, Artificial Sequence
  glucagon analogue
GTNLSVPNPLGFFPDHQLDPAFRANSNNPDWDFNPNKDHWPEANKVG

SEQ ID NO: 1968 - protein, 47 aa, Artificial Sequence; identical to SEQ ID NO: 1967
  glucagon analogue
  MISC_FEATURE (1)..(1): N-terminal acylation with a C14 fatty acyl group

SEQ ID NO: 1969 - protein, 40 aa, Artificial Sequence
  glucagon analogue
  misc_feature (2)..(2): Xaa at position 2 is amino isobutyric acid
  misc_feature (10)..(10): Lys acylated with a C14 fatty acyl group via gamma-Glu spacer
  misc_feature (40)..(40): Lys pegylated with 20K PEG
HXEGTFTSDKSSYLEEQAAREFIAWLVRGGPSSGAPPPSK

SEQ ID NO: 1970 - protein, 40 aa, Artificial Sequence; identical to SEQ ID NO: 1969
  glucagon analogue
  misc_feature (2)..(2): Xaa at position 2 is amino isobutyric acid
  misc_feature (10)..(10): Lys acylated with a C16 fatty acyl group via gamma-Glu spacer
  misc_feature (40)..(40): Lys pegylated with 10K PEG

SEQ ID NO: 1971 - protein, 40 aa, Artificial Sequence; identical to SEQ ID NO: 1969
  glucagon analogue
  misc_feature (2)..(2): Xaa at position 2 is amino isobutyric acid
  misc_feature (10)..(10): Lys acylated with a C16 fatty acyl group via succinoly spacer

SEQ ID NO: 1972 - protein, 39 aa, Artificial Sequence; identical to SEQ ID NO: 1946
  glucagon analogue
  misc_feature (2)..(2): Xaa at position 2 is amino isobutyric acid

SEQ ID NO: 1973 - protein, 40 aa, Artificial Sequence; identical to SEQ ID NO: 1969
  glucagon analogue
  misc_feature (2)..(2): Xaa at position 2 is amino isobutyric acid
  misc_feature (10)..(10): Lys acylated with a C16 fatty acyl group via gamma-Glu spacer
  misc_feature (40)..(40): Lys pegylated with 20K PEG

SEQ ID NO: 1974 - protein, 40 aa, Artificial Sequence; identical to SEQ ID NO: 1961
  glucagon analogue
  misc_feature (2)..(2): Xaa at position 2 is amino isobutyric acid
  misc_feature (40)..(40): Lys pegylated with 20K PEG

SEQ ID NO: 1975 - protein, 40 aa, Artificial Sequence
  glucagon analogue
  misc_feature (2)..(2): Xaa at position 2 is amino isobutyric acid
  misc_feature (24)..(24): Lys pegylated with 20K PEG
  misc_feature (40)..(40): Lys pegylated with 20K PEG
HXEGTFTSDVSSYLEEQAAREFIKWLVRGGPSSGAPPPSK

SEQ ID NO: 1976 - protein, 40 aa, Artificial Sequence; identical to SEQ ID NO: 1975
  glucagon analogue
  misc_feature (2)..(2): Xaa at position 2 is amino isobutyric acid
  misc_feature (24)..(24): Lys pegylated with 10K PEG
  misc_feature (40)..(40): Lys pegylated with 10K PEG

SEQ ID NO: 1977 - protein, 40 aa, Artificial Sequence
  glucagon analogue
  MISC_FEATURE (40)..(40): Lys pegylated with 20K PEG
HSQGTFTSDYSIYLDSRRAQDFVQWLMNTGPSSGAPPPSK

SEQ ID NO: 1978 - protein, 40 aa, Artificial Sequence
  glucagon analogue
  misc_feature (2)..(2): Xaa at position 2 is amino isobutyric acid
  misc_feature (20)..(20): Xaa at position 20 is amino isobutyric acid
  misc_feature (40)..(40): Lys pegylated with 20K PEG
YXEGTFISDYSIYLDRQAAXEFVNWLLAGGPSSGAPPPSK

SEQ ID NO: 1979 - protein, 47 aa, Artificial Sequence
  glucagon analogue
  MISC_FEATURE (1)..(1): N-terminal acylation with a C14 fatty acyl group
GTNLSVPNPRGFFPDHQLDPAFRANSNNPDWDFNPNKDHWPEANKVG

SEQ ID NO: 1980 - protein, 40 aa, Artificial Sequence; identical to SEQ ID NO: 1961
  glucagon analogue
  misc_feature (2)..(2): Xaa at position 2 is amino isobutyric acid
  misc_feature (40)..(40): Lys pegylated with 10K PEG

SEQ ID NO: 1981 - protein, 40 aa, Artificial Sequence; identical to SEQ ID NO: 1961
  glucagon analogue
  misc_feature (2)..(2): Xaa at position 2 is amino isobutyric acid
  misc_feature (40)..(40): Lys pegylated with 20K PEG

SEQ ID NO: 1982 - protein, 41 aa, Artificial Sequence
  glucagon analogue
  misc_feature (2)..(2): Xaa at position 2 is amino isobutyric acid
  misc_feature (40)..(40): Lys pegylated with 10K PEG
HXEGTFTSDVSSYLEEQAAREFIAWLVRGGPSSGAPPPSKC

SEQ ID NO: 1983 - protein, 40 aa, Artificial Sequence
  glucagon analogue
  misc_feature (2)..(2): Xaa at position 2 is amino isobutyric acid
  misc_feature (30)..(30): Lys pegylated with 20K PEG
  misc_feature (40)..(40): Lys pegylated with 20K PEG
HXEGTFTSDVSSYLEEQAAREFIAWLVRGKPSSGAPPPSK

SEQ ID NO: 1984 - protein, 40 aa, Artificial Sequence; identical to SEQ ID NO: 1983
  glucagon analogue
  misc_feature (2)..(2): Xaa at position 2 is amino isobutyric acid
  misc_feature (30)..(30): Lys pegylated with 10K PEG
  misc_feature (40)..(40): Lys pegylated with 10K PEG

SEQ ID NO: 1985 - protein, 43 aa, Artificial Sequence
  glucagon analogue
  misc_feature (2)..(2): Xaa at position 2 is amino isobutyric acid
  misc_feature (20)..(20): Xaa at position 20 is amino isobutyric acid
  misc_feature (43)..(43): Lys pegylated with 20K PEG
YXEGTFISDYSIAMDRIHQXDFVNWLLAQRGRRNDWRHNITQK

SEQ ID NO: 1986 - protein, 40 aa, Artificial Sequence
  glucagon analogue
  misc_feature (2)..(2): Xaa at position 2 is amino isobutyric acid
  misc_feature (20)..(20): Xaa at position 20 is amino isobutyric acid
  misc_feature (40)..(40): Lys pegylated with 20K PEG
YXEGTFISDYSIAMDRIHQXDFVNWLLAGGPSSGAPPPSK

SEQ ID NO: 1987 - protein, 39 aa, Artificial Sequence; identical to SEQ ID NO: 758
  glucagon analogue
  misc_feature (2)..(2): Xaa at position 2 is amino isobutyric acid
  misc_feature (10)..(10): Lys acylated with a C16 fatty acyl group via gamma-Glu spacer
  misc_feature (20)..(20): Xaa at position 20 is amino isobutyric acid

SEQ ID NO: 1988 - protein, 40 aa, Artificial Sequence; identical to SEQ ID NO: 756
  glucagon analogue
  misc_feature (2)..(2): Xaa at position 2 is amino isobutyric acid
  misc_feature (20)..(20): Xaa at position 20 is amino isobutyric acid
  misc_feature (40)..(40): Lys acylated with a C16 fatty acyl group via gamma-Glu spacer

SEQ ID NO: 1989 - protein, 40 aa, Artificial Sequence
  glucagon analogue
  misc_feature (16)..(16): Xaa at position 16 is amino isobutyric acid
  misc_feature (40)..(40): Lys pegylated with 20K PEG
HSQGTFTSDYSIYLDXRRAQDFVQWLMNTGPSSGAPPPSK

SEQ ID NO: 1990 - protein, 40 aa, Artificial Sequence
  glucagon analogue
  misc_feature (16)..(16): Xaa at position 16 is amino isobutyric acid
  misc_feature (40)..(40): Lys pegylated with 20K PEG
HSQGTFISDYSIYLDXRRAQDFVQWLMNTGPSSGAPPPSK

SEQ ID NO: 1991 - protein, 39 aa, Artificial Sequence; identical to SEQ ID NO: 758
  glucagon analogue
  misc_feature (2)..(2): Xaa at position 2 is amino isobutyric acid
  misc_feature (10)..(10): Lys acylated with a C16 fatty acyl group via gamma-Glu spacer
  misc_feature (20)..(20): Xaa at position 20 is amino isobutyric acid

SEQ ID NO: 1992 - protein, 40 aa, Artificial Sequence
  glucagon analogue
  misc_feature (2)..(2): Xaa at position 2 is amino isobutyric acid
  misc_feature (10)..(10): Lys acylated with a C16 fatty acyl group via gamma-Glu spacer
HXEGTFTSDKSRYLDERAAQEFVAWLLDAGPSSGAPPPSK

SEQ ID NO: 1993 - protein, 40 aa, Artificial Sequence
  glucagon analogue
  misc_feature (2)..(2): Xaa at position 2 is amino isobutyric acid
  misc_feature (10)..(10): Lys acylated with a C16 fatty acyl group via gamma-Glu spacer
HXQGTFTSDKSRYLDERAAQDFVQWLLDAGPSSGAPPPSK

SEQ ID NO: 1994 - protein, 40 aa, Artificial Sequence
  glucagon analogue
  misc_feature (2)..(2): Xaa at position 2 is amino isobutyric acid
  misc_feature (10)..(10): Lys acylated with a C16 fatty acyl group via gamma-Glu spacer
HXQGTFTSDKSRYLDERAAQDFVQWLLDGGPSSGAPPPSK

SEQ ID NO: 1995 - protein, 40 aa, Artificial Sequence
  glucagon analogue
  misc_feature (2)..(2): Xaa at position 2 is amino isobutyric acid
  misc_feature (10)..(10): Lys acylated with a C16 fatty acyl group via gamma-Glu spacer
HXEGTFTSDKSRYLDERAAQDFVQWLLDGGPSSGAPPPSK

SEQ ID NO: 1996 - protein, 38 aa, Artificial Sequence
  glucagon analogue
  misc_feature (1)..(1): Xaa at position 2 is amino isobutyric acid
  misc_feature (9)..(9): Lys acylated with a C16 fatty acyl group via gamma-Glu spacer
  misc_feature (19)..(19): Xaa at position 2 is amino isobutyric acid
XEGTFTSDKSIYLDKQAAXEFVNWLLAGGPSSGAPPPS

SEQ ID NO: 1997 - protein, 40 aa, Artificial Sequence
  glucagon analogue
  MISC_FEATURE (40)..(40): Lys pegylated with 20K PEG
HSQGTFTSDYSRYLDSRRAQDFVQWLMNTGPSSGAPPPSK

SEQ ID NO: 1998 - protein, 39 aa, Artificial Sequence
  glucagon analogue
  misc_feature (2)..(2): Xaa at position 2 is amino isobutyric acid
  misc_feature (20)..(20): Lys acylated with a (miniPEG)2-gamma Glu spacer
HXEGTFTSDYSKYLDERAAKDFVQWLLEGGPSSGAPPPS

SEQ ID NO: 1999 - protein, 39 aa, Artificial Sequence
  glucagon analogue
  misc_feature (2)..(2): Xaa at position 2 is amino isobutyric acid
  misc_feature (10)..(10): Lys acylated with a (miniPEG)2-gamma Glu spacer
HXEGTFTSDKSKYLDERAAQDFVQWLLEGGPSSGAPPPS

SEQ ID NO: 2000 - protein, 40 aa, Artificial Sequence
  glucagon analogue
  misc_feature (2)..(2): Xaa at position 2 is amino isobutyric acid
  misc_feature (40)..(40): Lys acylated with a (miniPEG)2-gamma Glu spacer
HXEGTFTSDYSKYLDERAAQDFVQWLLEGGPSSGAPPPSK

SEQ ID NO: 2001 - protein, 39 aa, Artificial Sequence
  glucagon analogue
  misc_feature (2)..(2): Xaa at position 2 is amino isobutyric acid
HXEGTFTSDYSKYLDERAAQDFVQWLLEGGPSSGAPPPS

SEQ ID NO: 2002 - protein, 40 aa, Artificial Sequence; identical to SEQ ID NO: 756
  glucagon analogue
  misc_feature (2)..(2): Xaa at position 2 is amino isobutyric acid
  misc_feature (20)..(20): Xaa at position 20 is amino isobutyric acid
  misc_feature (40)..(40): Lys acylated with a (miniPEG)2-gamma Glu spacer

SEQ ID NO: 2003 - protein, 39 aa, Artificial Sequence; identical to SEQ ID NO: 758
  glucagon analogue
  misc_feature (2)..(2): Xaa at position 2 is amino isobutyric acid
  misc_feature (10)..(10): Lys acylated with a (miniPEG)2-gamma Glu spacer
  misc_feature (20)..(20): Xaa at position 20 is amino isobutyric acid

SEQ ID NO: 2004 - protein, 40 aa, Artificial Sequence; identical to SEQ ID NO: 756
  glucagon analogue
  misc_feature (2)..(2): Xaa at position 2 is amino isobutyric acid
  misc_feature (20)..(20): Xaa at position 20 is amino isobutyric acid
  misc_feature (40)..(40): Lys acylated with a (miniPEG)2-gamma Glu spacer

SEQ ID NO: 2005 - protein, 40 aa, Artificial Sequence; identical to SEQ ID NO: 756
  glucagon analogue
  misc_feature (2)..(2): Xaa at position 2 is amino isobutyric acid
  misc_feature (20)..(20): Xaa at position 20 is amino isobutyric acid
  misc_feature (40)..(40): Lys acylated with a C16 fatty acyl diacid group via gamma-Glu spacer

SEQ ID NO: 2006 - protein, 39 aa, Artificial Sequence; identical to SEQ ID NO: 758
  glucagon analogue
  misc_feature (2)..(2): Xaa at position 2 is amino isobutyric acid
  misc_feature (10)..(10): Lys acylated with a C16 fatty acyl diacid group via gamma-Glu spacer
  misc_feature (20)..(20): Xaa at position 20 is amino isobutyric acid

SEQ ID NO: 2007 - protein, 39 aa, Artificial Sequence; identical to SEQ ID NO: 757
  glucagon analogue
  misc_feature (2)..(2): Xaa at position 2 is amino isobutyric acid
  misc_feature (20)..(20): Xaa at position 20 is amino isobutyric acid

SEQ ID NO: 2008 - protein, 39 aa, Artificial Sequence
  glucagon analogue
  misc_feature (2)..(2): Xaa at position 2 is amino isobutyric acid
  misc_feature (10)..(10): Lys acylated with a C16 fatty acyl group via gamma-Glu spacer
HXEGTFTSDKSSYLEEQAAKEFVNWLLAGGPSSGAPPPS

SEQ ID NO: 2009 - protein, 39 aa, Artificial Sequence
  glucagon analogue
  misc_feature (2)..(2): Xaa at position 2 is amino isobutyric acid
  misc_feature (10)..(10): Lys acylated with a C16 fatty acyl group via gamma-Glu spacer
  misc_feature (20)..(20): Xaa at position 20 is amino isobutyric acid
YXEGTFISDKSIYLDKQAAXEFVNWLLAGGPSSGAPPPS

SEQ ID NO: 2010 - protein, 39 aa, Artificial Sequence; identical to SEQ ID NO: 758
  glucagon analogue
  misc_feature (2)..(2): Xaa at position 2 is amino isobutyric acid
  misc_feature (10)..(10): Lys acylated with a C16 fatty acyl group via gamma-Glu spacer
  misc_feature (20)..(20): Xaa at position 20 is amino isobutyric acid

SEQ ID NO: 2011 - protein, 39 aa, Artificial Sequence; identical to SEQ ID NO: 758
  glucagon analogue
  misc_feature (2)..(2): Xaa at position 2 is amino isobutyric acid
  misc_feature (10)..(10): Xaa at position 2 is amino isobutyric acid
  misc_feature (20)..(20): Xaa at position 20 is amino isobutyric acid

SEQ ID NO: 2012 - protein, 39 aa, Artificial Sequence; identical to SEQ ID NO: 758
  glucagon analogue
  misc_feature (2)..(2): Xaa at position 2 is amino isobutyric acid
  misc_feature (10)..(10): Lys acylated with a C16 fatty acyl group via gamma-Glu spacer
  misc_feature (20)..(20): Xaa at position 20 is amino isobutyric acid

SEQ ID NO: 2013 - protein, 39 aa, Artificial Sequence
  glucagon analogue
  misc_feature (2)..(2): Xaa at position 2 is amino isobutyric acid
  misc_feature (10)..(10): Lys acylated with a C16 fatty acyl group via gamma-Glu spacer
  misc_feature (20)..(20): Xaa at position 20 is amino isobutyric acid
HXEGTFTSDKSIYLDKQAAXEFVNWLLAGGPSSGAPPPS

SEQ ID NO: 2014 - protein, 39 aa, Artificial Sequence; identical to SEQ ID NO: 758
  glucagon analogue
  misc_feature (2)..(2): Xaa at position 2 is amino isobutyric acid
  misc_feature (10)..(10): Lys acylated with a C16 fatty acyl group via gamma-Glu spacer
  misc_feature (20)..(20): Xaa at position 20 is amino isobutyric acid

SEQ ID NO: 2015 - protein, 39 aa, Artificial Sequence; identical to SEQ ID NO: 2013
  glucagon analogue
  misc_feature (2)..(2): Xaa at position 2 is amino isobutyric acid
  misc_feature (10)..(10): Lys acylated with a C16 fatty acyl group via gamma-Glu spacer
  misc_feature (20)..(20): Xaa at position 20 is amino isobutyric acid

SEQ ID NO: 2016 - protein, 39 aa, Artificial Sequence; identical to SEQ ID NO: 758
  glucagon analogue
  misc_feature (2)..(2): Xaa at position 2 is amino isobutyric acid
  misc_feature (10)..(10): Lys acylated with a C18 fatty acyl group via gamma-Glu spacer
  misc_feature (20)..(20): Xaa at position 20 is amino isobutyric acid

SEQ ID NO: 2017 - protein, 39 aa, Artificial Sequence; identical to SEQ ID NO: 758
  glucagon analogue
  misc_feature (2)..(2): Xaa at position 2 is amino isobutyric acid
  misc_feature (10)..(10): Lys acylated with a C20 fatty acyl group via gamma-Glu spacer
  misc_feature (20)..(20): Xaa at position 20 is amino isobutyric acid

SEQ ID NO: 2018 - protein, 39 aa, Artificial Sequence; identical to SEQ ID NO: 758
  glucagon analogue
  misc_feature (2)..(2): Xaa at position 2 is amino isobutyric acid
  misc_feature (10)..(10): Lys acylated with a C16 fatty acyl group via gamma-Glu spacer
  misc_feature (20)..(20): Xaa at position 20 is amino isobutyric acid

SEQ ID NO: 2019 - protein, 40 aa, Artificial Sequence
  glucagon analogue
  misc_feature (2)..(2): Xaa at position 2 is amino isobutyric acid
  misc_feature (10)..(10): Lys acylated with a C18 fatty acyl group via gamma-Glu spacer
  misc_feature (20)..(20): Xaa at position 20 is amino isobutyric acid
YXEGTFTSDKSIYLDKQAAXEFVNWLLAGGPSSSGAPPPS

SEQ ID NO: 2020 - protein, 40 aa, Artificial Sequence; identical to SEQ ID NO: 756
  glucagon analogue
  misc_feature (2)..(2): Xaa at position 2 is amino isobutyric acid
  misc_feature (10)..(10): Lys acylated with a C20 fatty acyl group via gamma-Glu spacer
  misc_feature (20)..(20): Xaa at position 20 is amino isobutyric acid
  misc_feature (40)..(40): Lys acylated with a C20 fatty acyl group via gamma-Glu spacer

SEQ ID NO: 2021 - protein, 40 aa, Artificial Sequence
  glucagon analogue
  misc_feature (2)..(2): Xaa at position 2 is amino isobutyric acid
  misc_feature (20)..(20): Xaa at position 20 is amino isobutyric acid
  misc_feature (40)..(40): Lys acylated with a C20 fatty acyl group via gamma-Glu spacer
YXEGTFISDYSIYLDKQAAXEFVNWLLAGGPSSGAPPPSK

SEQ ID NO: 2022 - protein, 40 aa, Artificial Sequence; identical to SEQ ID NO: 2021
  glucagon analogue
  misc_feature (2)..(2): Xaa at position 2 is amino isobutyric acid
  misc_feature (20)..(20): Xaa at position 20 is amino isobutyric acid
  misc_feature (40)..(40): Lys acylated with a C16 fatty acyl group via gamma-Glu spacer

SEQ ID NO: 2023 - protein, 39 aa, Artificial Sequence
  glucagon analogue
  misc_feature (1)..(1): Xaa at position 2 is amino isobutyric acid
  misc_feature (10)..(10): Lys acylated with a miniPEG) gamma Glu-C18 diacid,
  misc_feature (19)..(19): Xaa at position 19 is amino isobutyric acid
  misc_feature (39)..(39): Lys acylated with a C16 fatty acyl group via gamma-Glu spacer
XEGTFTSDYSIYLDKQAAXEAVNWLLAGGPSSGAPPPSK

SEQ ID NO: 2024 - protein, 40 aa, Artificial Sequence; identical to SEQ ID NO: 744
  glucagon analogue
  misc_feature (2)..(2): Xaa at position 2 is amino isobutyric acid
  misc_feature (40)..(40): Lys acylated with a C16 fatty acyl group via gamma-Glu spacer

SEQ ID NO: 2025 - protein, 40 aa, Artificial Sequence
  glucagon analogue
  misc_feature (2)..(2): Xaa at position 2 is amino isobutyric acid
  misc_feature (20)..(20): Xaa at position 20 is amino isobutyric acid
  misc_feature (40)..(40): Lys acylated with a C16 fatty acyl group via gamma-Glu spacer
HXEGTFTSDVSSYLEKQAAXEFVNWLLAGGPSSGAPPPSK

SEQ ID NO: 2026 - protein, 40 aa, Artificial Sequence
  glucagon analogue
  misc_feature (2)..(2): Xaa at position 2 is amino isobutyric acid
  misc_feature (20)..(20): Xaa at position 20 is amino isobutyric acid
  misc_feature (40)..(40): Lys acylated with a C16 fatty acyl group via gamma-Glu spacer
HXEGTFTSDVSIYLDKQAAXEFVNWLLAGGPSSGAPPPSK

SEQ ID NO: 2027 - protein, 31 aa, Artificial Sequence; identical to SEQ ID NO: 700
  Insulin conjugate

SEQ ID NO: 2028 - protein, 29 aa, Artificial Sequence
  Insulin conjugate
HSQGTFTSDYSKYLDSRRAQDFVQWLMNT

SEQ ID NO: 2029 - protein, 41 aa, Artificial Sequence
  glucagon analogue
  misc_feature (2)..(2): Xaa at position 2 is amino isobutyric acid
  misc_feature (40)..(40): Xaa at position 40 can be pegylated (10 or 20kd), or acylated with C16 via a gamma glu linker
HXEGTFTSDVSSYLEEQAAREFIAWLVRGGPSSGAPPPSXC

SEQ ID NO: 2030 - protein, 40 aa, Artificial Sequence
  glucagon analogue
  misc_feature (2)..(2): Xaa at position 2 is amino isobutyric acid
  misc_feature (10)..(10): Xaa at position 40 can be pegylated (10 or 20kd), or acylated with C16 via a gamma glu linker
HXEGTFTSDXSSYLEEQAAREFIAWLVRGGPSSGAPPPSC

SEQ ID NO: 2031 - protein, 40 aa, Artificial Sequence
  glucagon analogue
  misc_feature (2)..(2): Xaa at position 2 is amino isobutyric acid
HXEGTFTSDVSSYLEEQAAREFIAWLVRGGPSSGAPPPSC

SEQ ID NO: 2032 - protein, 41 aa, Artificial Sequence; identical to SEQ ID NO: 2029
  glucagon analogue
  misc_feature (2)..(2): Xaa at position 2 is amino isobutyric acid
  misc_feature (10)..(10): Xaa at position 10 can be pegylated (10 or 20kd), or acylated with C16 via a gamma glu linker
  misc_feature (40)..(40): Xaa at position 40 can be pegylated (10 or 20kd), or acylated with C16 via a gamma glu linker

SEQ ID NO: 2033 - protein, 40 aa, Artificial Sequence
  Glucagon analogue
  misc_feature (2)..(2): Xaa can be any naturally occurring amino acid
HXEGTFTSDVSSYLEEQAAKEFIAWLVKGGPSSGAPPPSC

SEQ ID NO: 2034 - protein, 41 aa, Artificial Sequence
  glucagon analogue
  misc_feature (2)..(2): Xaa at position 2 is amino isobutyric acid
  misc_feature (10)..(10): Lys acylated with a C16 fatty acyl group via gamma-Glu spacer
HXEGTFTSDKSSYLEEQAAKEFIAWLVKGGPSSGAPPPSGC

SEQ ID NO: 2035 - protein, 42 aa, Artificial Sequence
  glucagon analogue
  misc_feature (2)..(2): Xaa at position 2 is amino isobutyric acid
  misc_feature (41)..(41): Lys acylated with a C16 fatty acyl group via gamma-Glu spacer
HXEGTFTSDVSSYLEEQAAKEFIAWLVKGGPSSGAPPPSGKC

SEQ ID NO: 2036 - protein, 6 aa, Artificial Sequence
  model synthetic peptide
  MOD_RES (6)..(6): AMIDATION
HSRGTF

SEQ ID NO: 2037 - protein, 39 aa, Artificial Sequence
  glucagon analogue
  misc_feature (1)..(1): Xaa at position 1 is His or Tyr
  misc_feature (2)..(2): Xaa at position 2 is amino isobutyric acid
  misc_feature (10)..(10): Lys acylated with a C16-C20 fatty acyl group via gamma-Glu spacer
  misc_feature (20)..(20): Xaa at position 20 is amino isobutyric acid
XXEGTFTSDXSIYLDKQAAXEFVNWLLAGGPSSGAPPPS

SEQ ID NO: 2038 - protein, 40 aa, Artificial Sequence
  glucagon analogue
  misc_feature (1)..(1): Xaa at position 1 is His or Tyr
  misc_feature (2)..(2): Xaa at position 2 is amino isobutyric acid
  misc_feature (20)..(20): Xaa at position 20 is amino isobutyric acid
  misc_feature (40)..(40): Lys acylated with a C16-C20 fatty acyl group via gamma-Glu spacer
XXEGTFTSDVSIYLDKQAAXEFVNWLLAGGPSSGAPPPSX

SEQ ID NO: 2039 - protein, 29 aa, Artificial Sequence
  glucagon analogue
  MISC_FEATURE (1)..(1): Xaa at position 1 is Tyr or His
  MISC_FEATURE (2)..(2): Xaa at position 2 = Ser, D-serine, Ala, D-alanine, Val, glycine, n-methyl serine, aminoisobutyric acid (AIB) or N-methyl alanine
  MISC_FEATURE (3)..(3): Xaa at position 3 is Gln or Glu
  MISC_FEATURE (7)..(7): Xaa at position 7 is Thr or Ile
  MISC_FEATURE (10)..(10): Xaa at position 10 is Lys, Tyr or Val
  MISC_FEATURE (12)..(12): Xaa at position 12 is Ser, Arg, Ile, or Lys
  MISC_FEATURE (15)..(15): Xaa at position 15 is Asp, or Glu
  MISC_FEATURE (16)..(16): Xaa at position 16 is Lys or Glu
  MISC_FEATURE (17)..(17): Xaa at position 17 is Arg or Gln
  MISC_FEATURE (20)..(20): Xaa at position 20 is Gln or Aib
  MISC_FEATURE (21)..(21): Xaa at position 21 is Glu, or Asp
  MISC_FEATURE (24)..(24): Xaa at position 24 is Ala, Gln, or Asn
  MISC_FEATURE (28)..(28): Xaa at position 28 is Ala, Glu or Asp
  MISC_FEATURE (29)..(29): Xaa at position 29 is Ala or Gly
XXXGTFXSDXSXYLXXXAAXXFVXWLLXX

SEQ ID NO: 2040 - protein, 21 aa, Artificial Sequence
  Analog of Insulin A chain
  MISC_FEATURE (8)..(8): Xaa at position 8 is  threonine or histidine
  MISC_FEATURE (9)..(9): Xaa at position 9 is  serin, lysine or alanine
  MISC_FEATURE (21)..(21): Xaa at position 21 is alanine, glycine, or asparagine
GIVEQCCXXICSLYQLENYCX

SEQ ID NO: 2041 - protein, 29 aa, Artificial Sequence
  Glucagon analog
HSQGTFTSDYSKYLDERRAQDFVQWLMNT

SEQ ID NO: 2042 - protein, 29 aa, Homo sapiens
HSQGTFTSDYSKYLDSRRAQDFVQWLMNT

SEQ ID NO: 2043 - protein, 39 aa, Artificial Sequence; identical to SEQ ID NO: 521
  Synthetic peptide

SEQ ID NO: 2044 - protein, 39 aa, Artificial Sequence; identical to SEQ ID NO: 1934
  glucagon analogue
  MISC_FEATURE (2)..(2): Xaa at position 2 = aminoisobutyric acid (AIB)
  MISC_FEATURE (20)..(20): Xaa at position 20 = aminoisobutyric acid (AIB)

The invention claimed is:

1. An incretin-insulin conjugate comprising
an incretin peptide and
an insulin agonist peptide, wherein said conjugate has agonist activity at both the insulin receptor and an incretin receptor, and the incretin peptide is linked to the insulin agonist peptide via a linear chain spacer, wherein the incretin peptide is selected from the group consisting of:

(i) the amino acid sequence: X1-X2-Gln-Gly-Thr-Phe-Thr-Ser-Asp-Tyr-Ser-Lys-Tyr-Leu-Asp-Ser-Arg-Arg-Ala-Gln-Asp-Phe-Val-Gln-Trp-Leu-Met-$Z_1$ (SEQ ID NO: 839) with 1 to 3 amino acid modifications thereto, wherein:

X1 is selected from the group consisting of: His, D-His, N-methyl-His, alpha-methyl-His, imidazole acetic acid, des-amino-His, hydroxyl-His, acetyl-His, homo-His, and alpha, alpha-dimethyl imidiazole acetic acid (DMIA);

X2 is selected from the group consisting of: Ser, D-Ser, Ala, D-Ala, Gly, N-methyl-Ser, Val, and alpha-aminoisobutyric acid (Aib);

$Z_1$ is selected from the group consisting of Asn-Thr-COOH, and Y-COOH, wherein Y is 1 to 2 amino acids, and further wherein:

(1) a lactam bridge connects the side chains of an amino acid at position i and an amino acid at position i+4, wherein i is 12, 16, 20 or 24, or (2) one, two, or three of the amino acids at positions 16, 20, 21, and 24 of the incretin peptide is substituted with an α,α-disubstituted amino acid;

and said incretin peptide has glucagon agonist activity;

(ii) the amino acid sequence of $X_1X_2X_3$GTFTSDX$_{10}$SX$_{12}$YLX$_{15}$X$_{16}$X$_{17}$X$_{18}$AX$_{20}$X$_{21}$FX$_{23}$X$_{24}$WLX$_{27}$X$_{28}$X$_{29}$ (SEQ ID NO: 1926), wherein:

$X_1$ is selected from the group consisting of His, D-His, des-amino-His, hydroxyl-His, acetyl-His, homo-His or alpha, alpha-dimethyl imidiazole acetic acid (DMIA), N-methyl His, alpha-methyl His, and imidazole acetic acid;

$X_2$ is selected from the group consisting of Ser, D-Ser, Ala, D-Ala, Val, Gly, N-methyl Ser, aminoisobutyric acid (Aib) and N-methyl Ala;

$X_3$ is selected from the group consisting of Gln, Glu, Orn and Nle;

$X_{10}$ is selected from the group consisting of Tyr, Val and Trp;

$X_{12}$ is selected from the group consisting of Ser, Lys and Arg;

$X_{15}$ is selected from the group consisting of Asp, Glu, cysteic acid, homoglutamic acid and homocysteic acid;

$X_{16}$ is selected from the group consisting of Ser, Gly, Glu, Gln, homoglutamic acid and homocysteic acid;

$X_{17}$ is selected from the group consisting of Arg, Gln, Lys, Cys, Orn, homocysteine and acetyl phenylalanine;

$X_{18}$ is selected from the group consisting of Arg, Ala, Lys, Cys, Orn, homocysteine and acetyl phenylalanine;

$X_{20}$ is selected from the group consisting of Gln, Lys, Arg, Orn and citrulline;

$X_{21}$ is selected from the group consisting of Gln, Glu, Asp, Lys, Cys, Orn and acetyl phenylalanine;

$X_{23}$ is selected from the group consisting of Val and Ile;

$X_{24}$ is selected from the group consisting of Ala, Gln, Glu, Lys, Cys, Orn, homocysteine and acetyl phenylalanine;

$X_{27}$ is selected from the group consisting of Met, Val, Leu and Nle;

$X_{28}$ is selected from the group consisting of Asn, Lys and Asp; and $X_{29}$ is selected from the group consisting of Thr, Gly, Lys, Cys, Orn, homocysteine and acetyl phenylalanine; or an analog of SEQ ID NO: 1926, wherein said analog differs from SEQ ID NO: 1926 by 1, 2 or 3 amino acid modifications;

(iii) an incretin peptide of SEQ ID NO: 701 or an analog thereof, wherein said analog is modified to comprise:

(a) an amino acid modification at position 1 that confers gastric inhibitory polypeptide (GIP) agonist activity, (b) (1) a lactam bridge between the side chains of amino acids at positions i and i+4 or between the side chains of amino acids at positions j and j+3, wherein i is 12, 13, 16, 17, 20 or 24, and wherein j is 17, or (2) one, two, three, or all of the amino acids at positions 16, 20, 21, and 24 of the incretin peptide of SEQ ID NO: 701 is substituted with an α,α-disubstituted amino acid, (c) amino acid modifications at one, two or all of positions 27, 28 and 29, and (d) 1-6 further amino acid modifications, wherein the EC50 of the analog for GIP receptor activation is about 10 nM or less;

(iv) the sequence of SEQ ID NO: 701 with (a) an amino acid at position 10 which is acylated with a C4 to C30 fatty acid, and (b) an Aib at position 16;

(v) an amino acid sequence that differs from SEQ ID NO: 701 by no more than ten amino acid modifications, comprising one or more amino acid substitutions with Aib at positions 16, 20, 21, and/or 24, and an amino acid modification at position 1 and/or 2 that provides reduced susceptibility to cleavage by dipeptidyl peptidase IV, wherein said incretin peptide exhibits at least 20% of the activity of native glucagon like peptide-1 (GLP-1) at the GLP-1 receptor;

(vi) any of the incretin peptides (i)-(v), further comprising the amino acid sequence of GPSSGAPPPS (SEQ ID NO: 1095) or XGPSSGAPPPS (SEQ ID NO: 1096) attached to the C-terminus of the incretin peptide, wherein X is any amino acid;

(vii) the amino acid sequence of SEQ ID NO: 701 with the following amino acid modifications: Tyr at position 1, an Aib at position 2, Lys at position 10, wherein the Lys is covalently bound to a C16 fatty acyl group via a γ-Glu-γ-Glu dipeptide spacer, Ile at position 12, Lys at position 16, Gln at position 17, Ala at position 18, Aib at position 20, Glu at position 21, Asn at position 24, Leu at position 27, Ala at position 28, Gly at position 29, followed by the amino acid sequence of SEQ ID NO: 1095 attached to the C-terminal amino acid at position 29, and a C-terminal amide in place of the C-terminal alpha carboxylate; and (viii) HSQGTFTSDYSKYLDSRRAQDFVQWLMNT (SEQ ID NO: 2042), HSQGTFTSDYSKYLDER-RAQDFVQWLMNT (SEQ ID NO: 2041), Y(aib)

EGTFISDYSIYLDRQAA(aib)EFVNWLLAG-GPSSGAPPPS (SEQ ID NO: 2044), Y(aib)EGTFTSDX$_{10}$SIYLDKQAA(aib)EFVNWLLAGGPSSGAPPPS (SEQ ID NO: 1987), X$_1$X$_2$EGTFTSDX$_{10}$SIYLDKQAAX$_{20}$EFVNWLL AGGPSSGAPPPS (SEQ ID NO: 2037) or X$_1$X$_2$EGTFTSDVSIYLDKQAAX$_{20}$EFVNWLLA GGPSSGAPPPSX$_{40}$ (SEQ ID NO: 2038), wherein:

$X_1$ is His or Tyr;
$X_2$ is alpha-aminoisobutyric acid (Aib);
$X_{10}$ is Lys acylated with a C16 to C20 fatty acid group via a gamma Glu linker;
$X_{20}$ is alpha-aminoisobutyric acid (Aib); and
$X_{40}$ is Lys acylated with a C16 to C20 fatty acid group via a gamma Glu linker; and (ix) X$_1$X$_2$X$_3$GTFX$_7$SDX$_{10}$SX$_{12}$YLX$_{15}$X$_{16}$X$_{17}$AAX$_{20}$X$_{21}$FVX$_{24}$WLLX$_{28}$X$_{29}$ (SEQ ID NO: 2039), wherein:

$X_1$ is Tyr or His;
$X_2$ is Ser, D-serine, Ala, Val, glycine, N-methyl serine, aminoisobutyric acid (Aib), N-methyl alanine or D-alanine;
$X_3$ is Glu or Gln;
$X_7$ is Thr or Ile;
$X_{10}$ is Lys, Tyr or Val;
$X_{12}$ is Ser, Lys, Arg or Ile;
$X_{15}$ is Glu or Asp;
$X_{16}$ is Glu or Lys;
$X_{17}$ is Gln or Arg;
$X_{20}$ is Gln or Aib;
$X_{21}$ is Glu or Asp;
$X_{24}$ is Asn, Gln or Ala;
$X_{28}$ is Ala, Glu, or Asp;
$X_{29}$ is Ala or Gly, wherein said insulin agonist peptide comprises an insulin A chain and an insulin B chain, wherein said insulin A chain comprises the amino acid sequence GIVX$_4$X$_5$CCX$_8$X$_9$X$_{10}$CX$_{12}$LX$_{14}$X$_{15}$LX$_{17}$X$_{18}$YCX$_{21}$-R$_{13}$ (SEQ ID NO: 19), and said B chain comprises the amino acid sequence R$_{22}$-X$_{25}$LCGX$_{29}$X$_{30}$LVX$_{33}$X$_{34}$LYLVCGX$_{41}$X$_{42}$GFX$_{45}$ (SEQ ID NO: 20), wherein:

$X_4$ is glutamic acid or aspartic acid;
$X_5$ is glutamine or glutamic acid;
$X_8$ is histidine, threonine or phenylalanine;
$X_9$ is serine, arginine, lysine, ornithine or alanine;
$X_{10}$ is isoleucine or serine;
$X_{12}$ is serine or aspartic acid;
$X_{14}$ is tyrosine, arginine, lysine, ornithine or alanine;
$X_{15}$ is glutamine, glutamic acid, arginine, alanine, lysine, ornithine or leucine;
$X_{17}$ is glutamic acid, aspartic acid, asparagine, lysine, ornithine or glutamine;
$X_{18}$ is methionine, asparagine, glutamine, aspartic acid, glutamic acid or threonine;
$X_{21}$ is selected from the group consisting of alanine, glycine, serine, valine, threonine, isoleucine, leucine, glutamine, glutamic acid, asparagine, aspartic acid, histidine, tryptophan, tyrosine, and methionine;
$X_{25}$ is histidine or threonine;
$X_{29}$ is selected from the group consisting of alanine, glycine and serine;
$X_{30}$ is selected from the group consisting of histidine, aspartic acid, glutamic acid, homocysteic acid and cysteic acid;
$X_{33}$ is selected from the group consisting of aspartic acid and glutamic acid;
$X_{34}$ is selected from the group consisting of alanine and threonine;
$X_{41}$ is selected from the group consisting of glutamic acid, aspartic acid and asparagine;
$X_{42}$ is selected from the group consisting of alanine, ornithine, lysine and arginine;
$X_{45}$ is tyrosine or phenylalanine;
$R_{22}$ is selected from the group consisting of AYRPSE (SEQ ID NO: 14), FVNQ (SEQ ID NO: 12), FVKQ (SEQ ID NO: 8), PGPE (SEQ ID NO: 11), a tripeptide glycine-proline-glutamic acid, a tripeptide valine-asparagine-glutamine, a dipeptide proline-glutamic acid, a dipeptide asparagine-glutamine, glutamine, glutamic acid and an N-terminal amine; and
$R_{13}$ is COOH or CONH$_2$;

wherein said linear chain spacer comprises the general structure of:

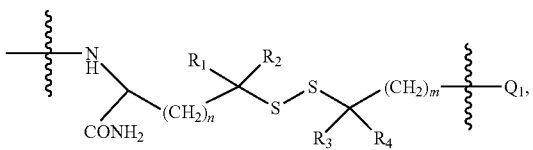

wherein $R_1$, $R_2$, $R_3$ and $R_4$ are independently selected from the group consisting of H and CH$_3$, n is 0 or 1, and m is 1, 2 or 3; and wherein the first end of the linear chain spacer is linked to the carboxy terminus of the incretin peptide via an amide bond, and the second end is linked to the N-terminus of the insulin B chain (Q$_1$).

2. The conjugate of claim 1, wherein the linear chain spacer comprises the general structure of:

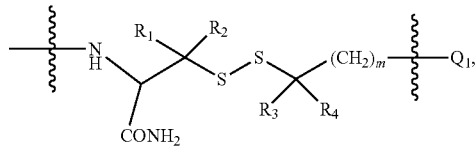

wherein
$R_2$ and $R_3$ are each H;
$R_1$ and $R_4$ are independently H or CH$_3$; and
m is 1 or 2.

3. The conjugate of claim 2, wherein
$R_1$, $R_2$, $R_3$ and $R_4$ are each H; and
m is 1 or 2.

4. The conjugate of claim 1, wherein said A chain comprises the amino acid sequence GIVEQCCX$_8$X$_9$ICSLYQLENYCX$_{21}$-R$_{13}$ (SEQ ID NO: 2040), said B chain comprises the amino acid sequence R$_{22}$-X$_{25}$LCGX$_{29}$X$_{30}$LVX$_{33}$X$_{34}$LYLVCGX$_{41}$X$_{42}$GFX$_{45}$ (SEQ ID NO: 20), wherein:

$X_8$ is histidine or threonine;
$X_9$ is serine, lysine, or alanine;
$X_{21}$ is alanine, glycine or asparagine;
$X_{25}$ is histidine or threonine;
$X_{29}$ is selected from the group consisting of alanine, glycine and serine;
$X_{30}$ is selected from the group consisting of histidine, aspartic acid, glutamic acid, homocysteic acid and cysteic acid;

$X_{33}$ is selected from the group consisting of aspartic acid and glutamic acid;

$X_{34}$ is selected from the group consisting of alanine and threonine;

$X_{41}$ is selected from the group consisting of glutamic acid, aspartic acid and asparagine;

$X_{42}$ is selected from the group consisting of alanine, ornithine, lysine and arginine;

$X_{45}$ is tyrosine or phenylalanine;

$R_{22}$ is selected from the group consisting of FVNQ (SEQ ID NO: 12), FVKQ (SEQ ID NO: 8), a tripeptide valine-asparagine-glutamine, a dipeptide asparagine-glutamine, glutamine and an N-terminal amine; and $R_{13}$ is COOH or $CONH_2$.

5. The conjugate of claim 4, wherein
said incretin peptide is selected from the group consisting of: Y(aib)EGTFTSDYSIYLDKQAA(aib)EFVNWL-LAGGPSSGAPPPS (SEQ ID NO:1930), H(aib)QGT-FTSDYSKYLDERAAQDFVQWLLDGGPSSGAP-PPS (SEQ ID NO: 1931), H(aib) EGTFTSDVSSYLEEQAAKEFIAWLVKGGPSSGA PPPS (SEQ ID NO: 1932), HSQGTFTSDYSKYLD-SRRAQDFVQWLMNTGPSSGAPPPS (SEQ ID NO: 2043), Y(aib)EGTFISDYSIYLDRQAA(aib)EFVN-WLLAGGPSSGAPPPS (SEQ ID NO: 2044), and Y(aib)EGTFTSDX$_{10}$SIYLDKQAA(aib)EFVNWL-LAGGPSSGAPPPS (SEQ ID NO: 1987);

wherein $X_{10}$ is Lys acylated with a C16 fatty acid group via a gamma Glu linker;

said linear chain spacer joining the incretin to the insulin agonist peptide comprises the general structure of:

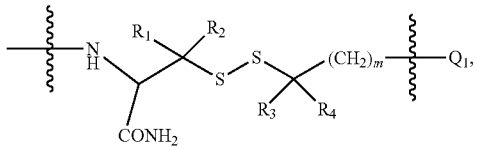

wherein $R_1$, $R_2$, $R_3$ and $R_4$ are independently selected from the group consisting of H and $CH_3$, and m is 1, 2 or 3; and
said insulin agonist peptide comprises an A chain sequence of GIVEQCCTSICSLYQLENYCN (SEQ ID NO: 1), and a B chain sequence selected from the group consisting of: FVNQHLCGSHLVEALYL-VCGERGFFYTPKT (SEQ ID NO: 2), FVNQHLCG-SHLVEALYLVCGERGFFYTKPT (SEQ ID NO: 9), FVNQHLCGSHLVEALYLVCGERGFFYTDKT (SEQ ID NO: 5), and FVKQHLCGSHLVEALYL-VCGERGFFYTEKT (SEQ ID NO: 6).

6. The conjugate of claim 5, wherein
i) the side chain of the amino acid at position 10 of the incretin peptide further comprises a non-native alkyl or acyl group; or
ii) the side chain of the amino acid at position 24, or an added C-terminal amino acid at position 40 of the incretin peptide, or the side chain of the amino acid at position B28 or B29 of the insulin agonist peptide is linked to a hydrophilic moiety; or
iii) a combination of i) and ii).

7. The conjugate of claim 1, wherein the insulin agonist peptide comprises:
an A chain sequence of GIVEQCCTSICSLYQLENYCN-$R_{13}$ (SEQ ID NO: 1); and
a B chain sequence selected from the group consisting of: FVNQHLCGSHLVEALYLVCGERGFFYTPKT (SEQ ID NO: 2), FVNQHLCGSHLVEALYL-VCGERGFFYTKPT (SEQ ID NO: 9), FVNQHLCG-SHLVEALYLVCGERGFFYTDKT (SEQ ID NO: 5) and FVKQHLCGSHLVEALYLVCGERGFFYTEKT (SEQ ID NO: 6), wherein $R_{13}$ is COOH or $CONH_2$; and
said linear chain spacer joining the incretin to the insulin agonist peptide comprises the general structure of:

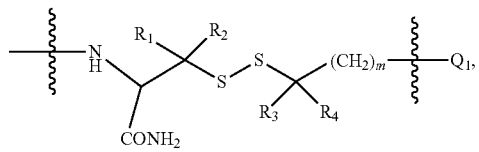

wherein
$R_2$ and $R_3$ are each H;
$R_1$ and $R_4$ are independently H or $CH_3$;
m is 2; and
$Q_1$ is the N-terminus of the insulin B chain.

8. The conjugate of claim 7, wherein the insulin agonist peptide comprises:
an A chain sequence of GIVEQCCTSICSLYQLENYCN (SEQ ID NO: 1); and
a B chain sequence of FVNQHLCGSHLVEALYL-VCGERGFFYTPKT (SEQ ID NO: 2);
said incretin peptide comprises the amino acid sequence Y(aib)EGTFTSDX$_{10}$SIYLDKQAA(aib)EFVNWL-LAGGPSSGAPPPS (SEQ ID NO: 1987);
wherein $X_{10}$ is Lys acylated with a C16 fatty acid group via a gamma Glu linker; and
said linear chain spacer joining the incretin to the insulin agonist peptide comprises the general structure of:

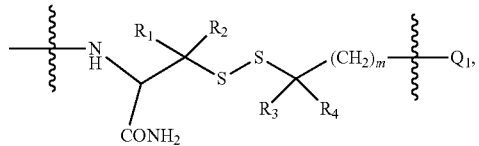

wherein
$R_1$, $R_2$, $R_3$ and $R_4$ are each H; and
m is 2;
wherein the first end of the linear chain spacer is linked to the carboxy terminus of the incretin peptide via an amide bond and the second end of the linear chain spacer is linked to $Q_1$, with $Q_1$ being the N-terminus of the insulin B chain.

9. The conjugate of claim 1, wherein
said incretin peptide comprises the amino acid sequence Y(aib)EGTFTSDX$_{10}$SIYLDKQAA(aib)EFVNWL-LAGGPSSGAPPPS (SEQ ID NO: 1987), Y(aib)EGT-FTSDYSIYLDKQAA(aib)EFVNWLLAGGPSSGAP-PPS (SEQ ID NO: 1930), or H(aib) QGTFTSDYSKYLDERAAQDFVQWLLDGGPSSG APPPS (SEQ ID NO: 1931);
wherein $X_{10}$ is Lys acylated with a C16 fatty acid group via a gamma Glu linker; and
said insulin agonist peptide comprises an A chain sequence of GIVEQCCTSICSLYQLENYCN (SEQ ID NO: 1), and a B chain sequence selected from the group consisting of: FVNQHLCGSHLVEALYL-VCGERGFFYTPKT (SEQ ID NO: 2), FVNQHLCG-SHLVEALYLVCGERGFFYTKPT (SEQ ID NO: 9), FVNQHLCGSHLVEALYLVCGERGFFYTDKT (SEQ ID NO: 5), and FVKQHLCGSHLVEALYL-VCGERGFFYTEKT (SEQ ID NO: 6), and wherein the linear chain spacer comprises the general structure of:

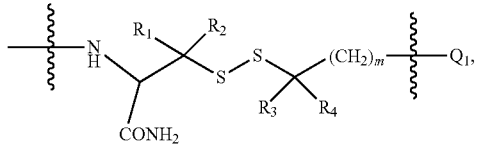

wherein $R_2$ and $R_3$ are each H;

$R_1$ and $R_4$ are independently H or $CH_3$; and m is 1 or 2.

10. The conjugate of claim 1, wherein the insulin agonist peptide is a single chain insulin and the peptide linker joining the B and A chains is selected from the group consisting of SSSSKAPPPSLPSPSRLPGPSDTPILPQR (SEQ ID NO: 1922), SSSSRAPPPSLPSPSRLPGPSDTPIL-PQK (SEQ ID NO: 1923), GAGSSSX$_{57}$X$_{58}$ (SEQ ID NO: 76), GYGSSSRR (SEQ ID NO: 61), GAGSSSRR (SEQ ID NO: 1925) and GYGSSSX$_{57}$X$_{58}$APQT (SEQ ID NO: 77), wherein $X_{57}$ and $X_{58}$ are independently arginine, lysine or ornithine.

11. The conjugate of claim 1, wherein the incretin peptide comprises the amino acid sequence $X_1X_2$EGTFTSDX$_6$SSYLEEQAAKEFIAWLVK-R$_4$ (SEQ ID NO: 1936), or $X_1X_2$QGTFTSDYSKYLDERX$_5$AKDFVX$_3$WLMN-R$_4$ (SEQ ID NO: 1937); wherein:

$X_1$ is selected from the group consisting of His, D-histidine, desaminohistidine, hydroxyl-histidine, acetyl-histidine, homo-histidine, alpha, alpha-dimethyl imidiazole acetic acid (DMIA), N-methyl histidine, alpha-methyl histidine, and imidazole acetic acid;

$X_2$ is selected from the group consisting of Ser, D-serine, Ala, Val, glycine, N-methyl serine, aminoisobutyric acid (Aib), N-methyl alanine and D-alanine;

$X_3$ is selected from the group consisting of Ala, Gln and Cys-PEG;

$R_4$ is selected from the group consisting of Thr-CONH$_2$, Cys-PEG, GGPSSGAPPPS (SEQ ID NO: 515), GGPSSGAPPPSC-PEG (SEQ ID NO: 516) and GGPSSGAPPPSCK(rEC16)C (SEQ ID NO: 1935);

$X_5$ is Ala or Arg and $X_6$ is selected from the group consisting of valine, tyrosine and K(rEC16)C; and wherein when $X_3$ is Cys-PEG, $R_4$ is not Cys-PEG or GGPSSGAPPPSC-PEG (SEQ ID NO: 516), and when $X_2$ is Ser, $X_1$ is not His.

12. The conjugate of claim 1, wherein the incretin peptide comprises an analog of glucagon (SEQ ID NO: 701) having GIP agonist activity, said analog comprising one or more of the following modifications:

(a) an amino acid modification at position 1 that confers GIP agonist activity, wherein the amino acid at position 1 is an amino acid lacking an imidazole side chain;

(b) an amino acid substitution of Ser at position 16 with an amino acid of Formula IV:

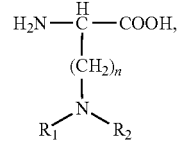
[Formula IV]

wherein n is an integer from 1 to 7, wherein each of $R_1$ and $R_2$ is independently selected from the group consisting of H, $C_1$-$C_{18}$ alkyl, ($C_1$-$C_{18}$ alkyl)OH, ($C_1$-$C_{18}$ alkyl)NH$_2$, ($C_1$-$C_{18}$ alkyl)SH, ($C_0$-$C_4$ alkyl)($C_3$-$C_6$)cycloalkyl, ($C_0$-$C_4$ alkyl)($C_2$-$C_5$ heterocyclic), ($C_0$-$C_4$ alkyl)($C_6$-$C_{10}$ aryl)$R_7$, and ($C_1$-$C_4$ alkyl)($C_3$-$C_9$ heteroaryl), wherein $R_7$ is H or OH, and the side chain of the amino acid of Formula IV comprises a free amino group, (c) one, two, three, or all of the amino acids at positions 16, 20, 21, and 24 of the analog is substituted with an α,α-disubstituted amino acid, (d) amino acid modifications at one, two or all of positions 27, 28 and 29, and (e) 1-9 further amino acid modifications relative to the glucagon sequence of SEQ ID NO: 701, wherein the EC50 of the analog for GIP receptor activation is about 10 nM or less.

13. The conjugate of claim 12, wherein the incretin peptide comprises the following modifications: (a) the amino acid at position 1 is a Tyr, and (b) wherein (i) the Met at position 27 is substituted with Leu, (ii) the Asn at position 28 is substituted with Ala, or (iii) the Thr at position 29 is substituted with Gly, or wherein the analog comprises a combination of (i), (ii), and (iii).

14. The conjugate of claim 13, wherein the incretin peptide further comprises one or more of the following modifications:

(a) Ser at position 2 substituted with D-Ser, Ala, D-Ala, Gly, N-methyl-Ser, Aib, Val, or α-amino-N-butyric acid;

(b) Gln at position 3 substituted with Glu;

(c) substitution of the amino acid Tyr at position 10 with an amino acid of Formula I:

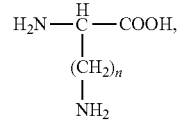

wherein n is an integer from 1 to 4, comprising a side chain covalently linked to an acyl group or alkyl group;

(d) addition of an amino acid of Formula I, comprising a side chain covalently linked to an acyl group or alkyl group at the C-terminal amino acid of the analog;

(e) Lys at position 12 substituted with Ile;

(f) Arg at position 17 substituted with Gln;

(g) Arg at position 18 substituted with Ala;

(h) Asp at position 21 substituted with Glu;

(i) Gln at position 24 substituted with Asn; or (j) replacement of the carboxylic acid of the C-terminal amino acid with an amide.

15. The conjugate of claim 1, wherein the incretin peptide comprises the amino acid sequence of: Y(aib) EGTFTSDX$_{10}$SIYLDKQAA(aib)EFVNWLLAGGPSS- GAPPPS (SEQ ID NO: 1987), HAEGTFTSDVSSYLE-EQAAREFIAWLVRGRG (SEQ ID NO: 700), HAEGTFTSDVSSYLEGQAAKEFIAWLVKGRG (SEQ ID NO: 703), HAEGTFTSDVSSYLEGQAAKE-FICWLVKGR (SEQ ID NO: 717), HSQGTFTSDYSKY-LDSRRAQDFVQWLMNT (SEQ ID NO: 2042), HSQGT-FTSDYSKYLDERRAQDFVQWLMNT (SEQ ID NO: 2041), or an analog of SEQ ID NO: 703, SEQ ID NO: 717, SEQ ID NO: 2042 or SEQ ID NO: 2041, wherein the incretin peptide or the analog further comprises a terminal extension of the amino acid sequence of GPSSGAPPPS (SEQ ID NO: 820) or GGPSSGAPPPS (SEQ ID NO: 515), wherein $X_{10}$ is Lys acylated with a C16 fatty acid group via a gamma Glu linker.

16. The conjugate of claim 1, wherein
said incretin peptide comprises an amino acid sequence selected from the group consisting of: Y(aib)EGTFTSDX$_{10}$SIYLDKQAAXEFVNWLLAGGPSSGAPPPS (SEQ ID NO: 1987), Y(aib)EGTFTSDYSI-YLDKQAA(aib)EFVNWLLAGGPSSGAPPPS (SEQ ID NO: 1930), H(aib)QGTFTSDYSKYLDERAAQD-FVQWLLDGGPSSGAPPPS (SEQ ID NO: 1931), H(aib)EGTFTSDVSSYLEEQAAKEFIAWLVKG-GPSSGAPPPS (SEQ ID NO: 1932), HSQGTFTS-DYSKYLDSRRAQDFVQWLMNTGGPSSGAPPPS (SEQ ID NO: 2043), and Y(aib)EGTFISDYSIYL-DRQAA(aib)EFVNWLLAGGPSSGAPPPS (SEQ ID NO: 2044), wherein $X_{10}$ is Lys acylated with a C16 fatty acid group via a gamma Glu linker;
said insulin peptide comprises
an A chain sequence consisting of GIVEQCCTSIC-SLYQLENYCN (SEQ ID NO: 1); and
a B chain sequence consisting of FVNQHLCG-SHLVEALYLVCGERGFFYTPKT (SEQ ID NO: 2); and
said linear chain spacer joining the incretin to the insulin peptide comprises the general structure of:

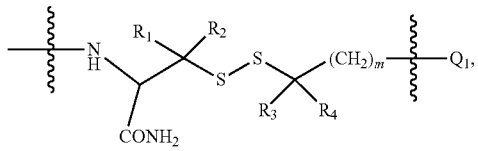

wherein
$R_1$ and $R_2$ are independently selected from H and $CH_2$, $R_3$ and $R_4$ are each H, and
m is 2.

17. A pharmaceutical composition comprising a conjugate of claim 1, or a pharmaceutically acceptable salt thereof, and a pharmaceutically acceptable carrier.

18. An incretin-insulin conjugate comprising
an incretin peptide and
an insulin agonist peptide, wherein said conjugate has agonist activity at both the insulin receptor and an incretin receptor, and the incretin peptide is linked to the insulin agonist peptide via a linear chain spacer, wherein
said insulin agonist peptide comprises:
an A chain sequence of GIVEQCCX$_8$SICSLYQLENYCX$_{21}$ (SEQ ID NO: 3); and
a B chain sequence of R$_{22}$-HLCGSHLVEALYL-VCGERGFX$_{45}$ (SEQ ID NO: 15), wherein the B chain is linked to the A chain through disulfide linkages; and $R_{22}$ is selected from the group consisting of FVNQ (SEQ ID NO: 12), FVKQ (SEQ ID NO: 8), VNQ, NQ and Q;
$X_8$ is selected from the group consisting of threonine and histidine;
$X_{21}$ is selected from the group consisting of asparagine, lysine, glycine, and alanine; and
$X_{45}$ is histidine, tyrosine or phenylalanine; and
said incretin peptide comprises the sequence $X_{80}X_{81}X_{82}$GTFTSDX$_{79}$SX$_{83}$YLX$_{84}$X$_{85}$X$_{86}$X$_{87}$AX$_{88}$X$_{89}$FX$_{90}$X$_{91}$WLX$_{92}$X$_{93}$X$_{94}$ (SEQ ID NO: 1928) or
$X_1X_2X_3$GTFX$_7$SDX$_{10}$SX$_{12}$YLX$_{15}$X$_{16}$X$_{17}$AAX$_{20}$X$_{21}$FVX$_{24}$WLLX$_{28}$X$_{29}$ (SEQ ID NO: 2039), wherein
the peptide of SEQ ID NO: 1928 further comprises a C-terminal extension $Z_1$; wherein:
$X_1$ is Tyr or His;
$X_2$ is Ser, D-serine, Ala, Val, glycine, N-methyl serine, aminoisobutyric acid (Aib), N-methyl alanine or D-alanine;
$X_3$ is Glu or Gln;
$X_7$ is Thr or Ile;
$X_{10}$ is Lys, Tyr or Val;
$X_{12}$ is Ser, Lys, Arg or Ile;
$X_{15}$ is Glu or Asp;
$X_{16}$ is Glu or Lys;
$X_{17}$ is Gln or Arg;
$X_{20}$ is Gln or Aib;
$X_{21}$ is Glu or Asp;
$X_{24}$ is Asn, Gln or Ala;
$X_{28}$ is Ala, Glu, or Asp;
$X_{29}$ is Ala or Gly;
$X_{79}$ is an amino acid covalently attached to a C12 to C18 acyl or alkyl group;
$X_{80}$ is His, Tyr, D-histidine, desaminohistidine, hydroxyl-histidine, acetyl-histidine, homo-histidine or alpha, alpha-dimethyl imidizole acetic acid (DMIA) N-methyl histidine, alpha-methyl histidine, or imidazole acetic acid;
$X_{81}$ is Ser, D-serine, Ala, Val, glycine, N-methyl serine or alpha-aminoisobutyric acid (Aib), N-methyl alanine or D-alanine;
$X_{82}$ is Gln or Glu;
$X_{83}$ is Lys or Ile;
$X_{84}$ is Asp or Glu;
$X_{85}$ is Lys, Arg, Ser or Glu;
$X_{86}$ is Arg or Gln;
$X_{87}$ is Ala or Arg;
$X_{88}$ is alpha-aminoisobutyric acid (Aib), Gln or Lys;
$X_{89}$ is Asp or Glu;
$X_{90}$ is Val or Ile;
$X_{91}$ is Asn, Gln or Ala;
$X_{92}$ is Leu, Val or Met;
$X_{93}$ is Ala, Asp, Lys Asn or Ala;
$X_{94}$ is Gly or Thr; and $Z_1$ is selected from the group consisting of —COOH, GPSSGAPPPS (SEQ ID NO: 820), KRNRNNIA (SEQ ID NO: 821) and KRNR (SEQ ID NO: 822); and
said linear chain spacer comprises the general structure of:

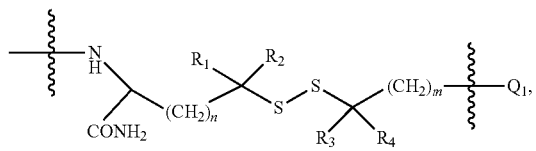

wherein $R_1$, $R_2$, $R_3$ and $R_4$ are independently selected from the group consisting of H and $CH_3$, n is 0 or 1, and m is 1, 2 or 3, and wherein the first end of the linear chain spacer is linked to the carboxy terminus of the incretin peptide via an amide bond, and the second end is linked to the N-terminus of the insulin B chain ($Q_1$).

19. The conjugate of claim 18, wherein $X_{80}$ is His or Tyr;

$X_{88}$ is aminoisobutyric acid (Aib); and $Z_1$ is GPSSGAPPPS (SEQ ID NO: 820).

* * * * *

UNITED STATES PATENT AND TRADEMARK OFFICE
CERTIFICATE OF CORRECTION

PATENT NO. : 10,232,020 B2
APPLICATION NO. : 15/513748
DATED : March 19, 2019
INVENTOR(S) : Richard D. Dimarchi et al.

It is certified that error appears in the above-identified patent and that said Letters Patent is hereby corrected as shown below:

In the Claims

In Claim 18, Column 146, Line 49, immediately following "$X_{90}$ is Val or" please delete "Be" and insert --Ile-- in its place.

Signed and Sealed this
Twenty-fourth Day of August, 2021

Drew Hirshfeld
*Performing the Functions and Duties of the
Under Secretary of Commerce for Intellectual Property and
Director of the United States Patent and Trademark Office*